US008372411B2

(12) United States Patent
Meinke et al.

(10) Patent No.: US 8,372,411 B2
(45) Date of Patent: Feb. 12, 2013

(54) S. PNEUMONIAE ANTIGENS

(75) Inventors: Andreas Meinke, Pressbaum (AT); Eszter Nagy, Vienna (AT); Markus Hanner, Vienna (AT); Shailesh Dewasthaly, Vienna (AT); Ulrike Stierschneider, Vienna (AT)

(73) Assignee: Intercell AG, Vienna (AT)

( * ) Notice: Subject to any disclaimer, the term of this patent is extended or adjusted under 35 U.S.C. 154(b) by 0 days.

(21) Appl. No.: 12/637,589

(22) Filed: Dec. 14, 2009

(65) Prior Publication Data

US 2010/0260790 A1    Oct. 14, 2010

Related U.S. Application Data

(63) Continuation of application No. 10/552,156, filed as application No. PCT/EP2004/003984 on Apr. 15, 2004, now Pat. No. 7,635,487.

(30) Foreign Application Priority Data

Apr. 15, 2003   (EP) .................................... 03450087

(51) Int. Cl.
  *A61K 39/09*   (2006.01)
  *A61K 39/02*   (2006.01)
  *C07K 14/315*   (2006.01)
(52) U.S. Cl. ................. 424/244.1; 424/190.1; 530/300; 530/350
(58) Field of Classification Search ......................... None
See application file for complete search history.

(56) References Cited

U.S. PATENT DOCUMENTS

| 4,946,778 | A | 8/1990 | Ladner et al. ................. 435/69.6 |
| 5,849,902 | A | 12/1998 | Arrow et al. ................. 536/24.5 |
| 5,989,912 | A | 11/1999 | Arrow et al. ................. 435/375 |
| 6,951,652 | B2 | 10/2005 | Porro ......................... 424/234.1 |
| 7,074,914 | B1 * | 7/2006 | Doucette-Stamm et al. 536/23.7 |

FOREIGN PATENT DOCUMENTS

| AU | A 1924/2001 | 6/2003 |
| CA | 2045869 | 12/1991 |
| DE | 197 42 706 | 4/1999 |
| EP | 0 464 533 | 1/1992 |
| EP | 0 533 838 | 3/1993 |
| JP | 2002-533123 | 10/2002 |
| WO | WO 93/00365 | 1/1993 |
| WO | WO 96/02555 | 2/1996 |
| WO | WO 98/08856 | 3/1998 |
| WO | WO 99/38528 | 8/1999 |
| WO | WO 01/54720 | 2/2001 |
| WO | WO 01/24822 | 4/2001 |
| WO | WO 01/49721 | 7/2001 |
| WO | WO 01/93903 | 12/2001 |
| WO | WO 01/93905 | 12/2001 |
| WO | WO 02/05448 | 1/2002 |
| WO | WO 02/13857 | 2/2002 |
| WO | WO 02/32451 | 4/2002 |
| WO | WO 02/34771 | 5/2002 |
| WO | WO 02/059148 | * 8/2002 |
| WO | WO 02/066650 | 8/2002 |
| WO | WO 02/077021 | 10/2002 |
| WO | WO 02/077183 | 10/2002 |
| WO | WO 02/083855 | 10/2002 |
| WO | WO 02/083859 | 10/2002 |
| WO | WO 02/092818 | 11/2002 |
| WO | WO 03/093306 | 11/2003 |
| WO | WO 2005/032582 | 4/2005 |
| WO | WO 97/30721 | 3/2007 |

OTHER PUBLICATIONS

Witkowski et al ( Biochemistry 38:11643-11650, 1999).*
Seffernick et al ( J. Bacteriol. 183(8): 2405-2410, 2001).*
US 5,744,309 (withdrawn).
Adamou et al., "Identification and characterization of a novel family of pneumococcal proteins that are protective against sepsis," *Infect. Immun.*, 69:949-58, 2001.
Altschul et al., "Basic local alignment search tool," *J. Mol. Biol.*, 215:403-10, 1990.
Bennett et al., "Kinetic characterization of the interaction of biotinylated human interleukin 5 with and Fc chimera of its receptors a subunit and development of an ELISA screening assay using real-time interaction biosensor analysis," *J. Mol. Recogn.*, 8:52-58, 1995.
Bethe et al., "The cell wall-associated serine protease PrtA: a highly conserved virulence factor of Streptococcus pneumoniae," *FEMS Microbiology Letters*, 205:99-104, 2001.
Brown et al., "Immunization with components of two iron uptake ABC transporters protects mice against systemic Streptococcus pneumoniae infection," *Infect. Immun.*, 69:6702-6, 2001.
Burnie et al., "The renaissance of antibody therapy," *J. Antimicrob. Chemother.*, 41:319-22, 1998.
Clackson et al., "Making antibody fragments using phage display libraries," *Nature*, 352:624-8, 1991.
Devereux et al., "A comprehensive set of sequence analysis programs for the VAX," *Nucleic Acids Research*, 12:387-95, 1984.
Di Guilmi et al., "New approaches towards the identification of antibiotic and vaccine targets in Streptococcus pneumoniae," *EMBO Reports*, 3:728-34, 2002.
Doherty et al., "Ribozyme structures and mechanisms," *Annu. Rev. Biophys. Biomol. Struct.*, 30:457-475, 2001.
Eisenbraun et al., "Examination of parameters affecting the elicitation of humoral immune responses by particle bombardment-mediated genetic immunization," *DNA Cell Bio.*, 112:791-7, 1993.
Ellis, In: Chapter 29: Vaccines, W.B. Saunders Company, 1988.
Etz et al., "Bacterial phage receptors, versatile tools for display of polypeptides on the cell surface," *J. Bacteriol.*, 183:6924-35, 2001.
Ganz, "Defensins and host defense," *Science*, 286:420-1, 1999.

(Continued)

*Primary Examiner* — Padma Baskar
(74) *Attorney, Agent, or Firm* — Wolf, Greenfield & Sacks, P.C.

(57) ABSTRACT

The present invention discloses isolated nucleic acid molecules encoding a hyperimmune serum reactive antigen or a fragment thereof as well as hyperimmune serum reactive antigens or fragments thereof from *S. pneumoniae*, methods for isolating such antigens and specific uses thereof.

30 Claims, 20 Drawing Sheets

OTHER PUBLICATIONS

Georgiou, "Display of heterologous proteins on the surface of microorganisms: from the screening of combinatorial libraries to live recombinant vaccines," Nature Biotechnology, 15:29-34, 1997.
Gray et al., "Clinical and epidemiologic studies of pneumococcal infection in children," Pediatric Infect. Dis., 5:201-7, 1986.
Gray et al., "Serotypes of Streptococcus pneumoniae causing disease," J. Infect. Dis., 140:979-83, 1979.
Hashemzadeh-Bonehi et al., "Microcorrespondence," Mol. Microbiol., 30:676-678, 1998.
Hausdorff et al., "Geographical differences in invasive pneumococcal disease rates and serotype frequency in young children," Lancet, 357:950-2, 2001.
Hemmer et al., "Identification of candidate T-cell epitopes and molecular mimics in chronic Lyme disease," Nat. Med., 5:1375-82, 1999.
Hoe et al., "Distribution of streptococcal inhibitor of complement variants in pharyngitis and invasive isolates in an epidemic of serotype M1 group A Streptococcus infection," J. M. Dis., 183:633-9, 2001.
Hornef et al., "Bacterial strategies for overcoming host innate and adaptive immune responses," Nat. Immunol., 3:1033-40, 2002.
Hoskins et al., "Genome of the bacterium Streptococcus pneumoniae Strain R6," Journal of Bacteriology, 183:5709-5717, 2001.
Hoskins et al., "Streptococcus pneumoniae Strain R6—section 1," retrived from http://www.ebi.ac.uk, Database accession No. AE008385, 2001.
Japanese Official Action, issued in Japanese Application No. 2006-505135, mailed Feb. 2, 2010 (English Translation).
Jedrzejas, "Pneumococcal virulence factors: structure and function," Microbiol. Mol. Biol. Rev., 65:187-207.
Johanson et al., "Binding interactions of human interleukin 5 with its receptor subunit," J. Biol. Chem., 270:9459-71, 1995.
Jones et al., "Replacing the complementarity—determining regions in a human antibody with those from a mouse," Nature, 321:522-5, 1986.
Kajava et al., "The net charge of the first 18 residues of the mature sequence affects protein translocation across the cytoplasmic membrane of gram-negative bacteria," J. Bacterial., 182:2163-9, 2000.
Kohler et al., "Continuous cultures of fused cells secreting antibody of predefined specificity," Nature, 256:495-7, 1975.
Kolaskar et al., "A semi-empirical method for prediction of antigenic determinants on protein antigens," FEBS Lett., 276:172-4, 1990.
Lewin et al., "Ribozyme gene therapy: applications for molecular medicine," Trends Mol. Med., 7:221-8, 2001.
Marks et al., "By-passing immunization: building high affinity human antibodies by chain suffering," Biotechnology, 10:779-83, 1992.
McCafferty et al., "Phage antibodies: filamentous phage displaying antibody variable domains," Nature, 348:552-4, 1990.
McCool et al., "The immune response to pneumococcal proteins during experimental human carriage," J. Exp. Med., 195:359-65, 2002.
McCormick et al., "Geographic diversity and temporal trends of antimicrobial resistance in Streptococcus pneumoniae in the United States," Nat. Med., 9:424-30, 2003.
McDaniel et al., "PspA, a surface protein of Streptococcus pneumoniae, is capable of eliciting protection against pneumococci of more than one capsular type," Infect. Immun., 59:222-8, 1991.
Nabors et al., "Immunization of healthy adults with a single recombinant pneumococcal surface protein A (PspA) variant stimulates broadly cross-relative antibodies to heterologous PspA molecules," Vaccine, 18:1743-1754, 2000.
Navarre et al., "Surface proteins of gram-positive bacteria and mechanisms of their targeting to the cell wall envelope," Microbiol. Mol. Biol. Rev., 63:174-229, 1999.
Office Action, issued in U.S. Appl. No. 10/552,156, mailed Sep. 11, 2006.
Office Action, issued in U.S. Appl. No. 10/552,156, mailed Dec. 5, 2006.
Office Action, issued in U.S. Appl. No. 10/552,156, mailed Jun. 19, 2007.
Office Action, issued in U.S. Appl. No. 10/552,156, mailed Feb. 21, 2008.
Office Action, issued in U.S. Appl. No. 10/552,156, mailed Dec. 5, 2008.
Okano et al., "Myelin basic protein gene and the function of antisense RNA in its repression in myelin-deficient mutant mouse," J. Neurochem., 56:560-7, 1991.
Orange et al., "Pneumococcal serotypes causing disease in children in Alabama," The Pediatric Infectious Disease Journal, 12:244-246, 1993.
Overweg et al., "The putative proteinase maturation protein a of Streptococcus pneumoniae is a conserved surface protein with potential to elicit protective immune responses," Infection and Immunity, 68:4180-4188, 2000.
Pelton et al., "Pneumococcal conjugates vaccines: proceedings from an interactive symposium at the 41st Interscience Conference on antimicrobial agents and chemotherapy," Vaccine, 21:1562-71, 2003.
Phillips-Quagliata et al., "The IgA/IgM receptor expressed on a murine B cell lymphoma is poly-Ig receptor," J. Immunol., 165:2544-55, 2000.
Rammensee et al., "SYFPEITHI: database for MHC ligands and peptide motifs," Immunogenetics, 50:213-9, 1999.
Roche et al., "Regions of PspA/EF3296 best able to elicit protection against Streptococcus pneumoniae in a murine infections model," Infect. Immun., 71:1033-41, 2003.
Romero-Steiner et al., "Reduction in functional antibody activity against Streptococcus pneumoniae in vaccinated elderly individuals highly correlates with decreased IgG antibody avidity," Clin. Infect. Dis., 29:281-8, 1999.
Rosenow et al., "Contirbution of novel choline-binding proteins to adherence, colonization and immunogenicity of Streptococcus pneumoniae," Mol. Microbiol., 25:819-29, 1997.
Seeger et al., "The cloned genome of ground squirrel hepatitis virus is infectious in the animal," Proc. Natl. Acad. Sci. USA, 81:5849-52, 1984.
Shibuya et al., "Fc/receptor mediates endocytosis of IgM-coated microbes," Nature Immun., 1:441-6, 2000.
Skerra, "Use of the tetracycline prometer for the tightly regulated production of a murine antibody fragment in Escherichia coli," Gene, 151:131-5, 1994.
Talkington et al., "Protection of mice against fatal pneumococcal challenge by immunization with pneumococcal surface adhesion A (PsaA)," Microb. Pathog., 21:17-22, 1996.
Tang et al., "Genetic immunization is a simple method for eliciting an immune response," Nature, 356:152-4, 1992.
Tettelin et al., "Complete genome sequence of a virulent isolate of Streptococcus pneumoniae," Science, 293:498-506, 2001.
Tettelin et al., "Streptococcus pneumoniae TIGR4—section 1," retrived from http://www.ebi.ac.uk, Database accession No. AE007318, 2001.
Tourdot et al., "A general strategy to enhance immunogenicity of low-affinity HLA-A2. 1-associated peptides implication in the identification of cryptic tumor epitopes," Eur. J. Immunol., 30:3411-21, 2000.
Wizemann et al., "Use of a whole genome approach to identify vaccine molecules affording protection against Streptococcus pneumoniae infection," Injection and Immunity, 69:1593-1598, 2001.
"Penicillin-binding protein (D-alanyl-D-alanine caboxypeptides)," retrieved from EBI accession No. UNIPROT:Q9A1G0, database accession No. Q9AIGO, Jun. 1, 2001.
"Puntative D-alanyl-D-alanine carboxypeptides," retrieved from EBI accession No. UNIPROT:Q8K8L9, database accession No. Q8K8L9, Oct. 1, 2002.
Abaza and Atassi, "Effects of amino acid substitutions outside an antigenic site on protein binding to monoclonal antibodies of predetermined specificity obtained by peptide immunization: demonstration with region 94-100 (antigenic site 3) of myoglobin," J. Prot. Chem., 11:433-44, 1992.
Beachey et al., Journal of Experimental Medicine, 150(4):862-77, 1979.

Beres et al., "Genome sequence of a serotype M3 strain of group A *Streptococcus*: phage-encoded toxins, the high-virulence phenotype, and clone emergence," *PNAS*, 99:10078-10083, 2002.

Berneman et al., "The specificity patterns of human immunoglobulin G antobodies in serum differ from those in autologous secretions," *Infect. Immun.*, 66:4163-68, 1998.

Bessen et al., "Influence of intranasal immunization with synthetic peptides corresponding to conserved epitopes of M protein on mucosal colonization by group A streptococci," *Infect. Immun.*, 56:2666-2672, 1988.

Bisno et al., "M proteins of group G streptococci isolated from bacteremic human infections," *Infect. Immun.*, 55:753-7, 1987.

Bronze et al., "Protective immunity evoked by locally administered group A streptococcal vaccines in mice," *J. Immunol.*, 141:2767-2770, 1988.

Colman, "Effects of amino acid sequence changes on antibody-antigen interactions," *Research in Immunology*, 145:33-6, 1994.

Cone et al., "Clinical and bacteriologic observations of a toxic shock-life syndrome due to *Streptococcus pyogenes*," *New Engl. J. Med.*, 317:146-9, 1987.

Cunningham, "Pathogenesis of group A streptococcal infections," *Clin. Microbiol. Rev.*, 13:470-511, 2000.

Database EMBL, "Sequence 619 from patent W003093306," XP002614710, retrieved from EBI Accession No. EMBL:AX953773, 2003.

Database EPO Proteins, "Sequence 620 from patent W003093306," XP002614709, retrieved from EBI Accession No. EPOP:AX953774, 2003.

Database Geneseq, "*Streptococcus agalactiae* DNA sequence, Seq. ID No. 5786," XP002614708, retrieved from EBI Accession No. GSN:ADV84645, 2002.

Database Geneseq, "*Streptococcus agalactiae* DNA sequence, Seq. ID No. 3650," XP002614707, retrieved from EBI Accession No. GSP:ADV82509, 2002.

Database Geneseq, "*Streptococcus* polynucleotide Seq. ID No. 7487," XP002614704, retrieved from EBI Accession No. GSN:ABN69787, 2002.

Database Geneseq, "*Streptococcus* polynucleotide Seq. ID No. 7488," XP002614705, retrieved from EBI Accession No. GSP:ABP29156, 2002.

Database Geneseq, "*Streptococcus* polypeptide Seq. ID No. 9130," XP002613362, retrieved from EBI Accession No. GSP:ABP29977, 2002.

Database Geneseq, "*Streptococcus* polypeptide Seq. ID No. 9187," XP002613294, retrieved from EBI Accession No. GSN:ABN70637, 2002.

Database Geneseq, "*Streptococcus* polypeptide Seq. ID No. 9188," XP002611639, retrieved from EBI Accession No. GSP:ABP30006, 2002.

Database Geneseq, XP002611641, retrieved from EBI Accession No. GSP:ABU46451, 2002.

Database Geneseq, XP002611642, retrieved from EBI Accession No. GSN:ACA50321, 2002.

Database Geneseq, XP002613364, retrieved from EBI Accession No. GSP:ABU46584, 2002.

Database Geneseq, XP002613365, retrieved from EBI Accession No. GSN:ACA50454, 2002.

Database UniProt, "SubName: Full=5'-nucleotidase; EC=3.1.3.5; SubName: Full-Putative secreted 5'-nucleotidase," XP002613363, retrieved from EBI Accession No. UNIPROT:Q9A0A2, 2001.

Database UniProt, "SubName: Full=Putative surface exclusion protein; SubName: Full=Surface exclusion protein," XP002613167, retrieved from EBI accession No. UNIPROT:Q9A1H3, 2001.

Database UniProt, "SubName: Full=Putative uncharacterized protein," XP002614706, retrieved from EBI accession No. UNIPROT:Q9A135, 2001.

Enright et al, "Multilocus sequence typing of *Streptococcus pyogenes* and the relationships between emm type and clone," *Infect. Immun.*, 69:2416-27, 2001.

European Examination Report, issued in European Application No. 09 001 321.0, mailed Aug. 30, 2010.

European Search Report, issued in Application No. 10180261.9, mailing date: Jan. 4, 2011.

European Search Report, issued in Application No. 10180269.2, mailing date: Jan. 4, 2011.

European Search Report, issued in Application No. 10180271.8, mailing date: Jan. 4, 2011.

Fenderson et al., "Tropomyosin shares immunologic epitopes with group a streptococcal M proteins," *J. Immunol.*, 142:2475-2481, 1989.

Ferretti et al., "Complete genome sequence of an M1 strain of *Streptococcus pyogenes*," *PNAS*, 98:4658-4663, 2001.

Fischetti, "Streptococcal M protein: molecular design and biological behavior," *Clin. Microbiol. Rev.*, 2:285-314, 1989.

Guzman et al., "Protective immune response against *Streptococcus pyogenes* in mice after intranasal vaccination with fibronectin-binding protein Sfbl," *J. Infect. Dis.*, 179:901-6, 1999.

Henics et al., "Small-fragment genomic libraries for the display of putative epitopes from clinically significant pathogens," *Biotechniques*, 35:196-209, 2003.

Hope-Simpson, "*Streptococcus pyogenes* in the throat: a study in a small population," *J. Hyg.* (London), 87:109-29, 1981.

Houghten et al, "Relative importance of position and amino acid residues in peptide antigen-antibody interactions: implications in the mechanism of antigenic drift and antigenic shift," In: *Vaccines*, Brown, Ed., Cold Spring Harbor Laboratory, pp. 21-25, 1986.

Japanese Office Action, issued in Japanese Application No. 2006-504505, dated Feb. 23, 2010 (English Translation).

Ji el al., "Intranasal immunization with C5a peptidase prevents nasopharyngeal colonization of mice by the group A *Streptococcus*," *Infect. Immun.*, 65:2080-2087, 1997.

Lee, "Quantification and toxicity of group A streptococcal pyrogenic exotoxins in an animal model of toxic shock syndrome-like illness," *J. Clin. Microbiol.*, 27:1890-2, 1989.

Office Action, issued in U.S. Appl. No. 10/548,463, mailed Dec. 4, 2008.

Office Action, issued in U.S. Appl. No. 10/548,463, mailed Apr. 29, 2008.

Office Action, issued in U.S. Appl. No. 10/548,463, mailed Oct. 18, 2007.

Office Action, issued in U.S. Appl. No. 10/548,463, mailed Nov. 2, 2006.

Office Action, issued in U.S. Appl. No. 10/548,463, mailed Sep. 1, 2006.

Office Action, issued in U.S. Appl. No. 12/642,361, mailed Mar. 3, 2011.

Office Action, issued in U.S. Appl. No. 12/642,361, mailed Oct. 25, 2010.

Reid at al., "Multilocus analysis of extracellular putative virulence proteins made by group A *Streptococcus*: population genetics, human serologic response, and gene transcription," *Proc. Natl. Acad Sci. USA*, 98:7552-7557, 2001.

Reid et al., "Postgenomic analysis of four novel antigens of group A *Streptococcus*: growth phase-dependent gene transcription and human serologic response," *J. Bacteriol.*, 184:6316-6324, 2002.

Rosenshine et al., "Tyosine protein kinase inhibitors block invasin-promoted bacterial uptake by epithelial cells," *Infect. Immun.*, 60:2211-7, 1992.

Smoot et al., "Genome sequence and comparative microarray analysis of serotype M18 group A *Streptococcus* strains associated with acute rheumatic fever outbreaks," *PNAS*, 99:4668-4673, 2002.

Stevens, "Invasive group A *Streptococcus* infections," *Clin. Infect. Dis.*, 14:2-11, 1992.

Tempest et al., "Reshaping a human monoclonal antibody to inhibit human respiratory syncytial virus infection in vivo," *Biotechnology*, 9:266-71, 1991.

Vandermeid et al., "Utilization of human antibodies to open reading frame proteins for evaluatino opsonophagocytic activity against *Streptococcus pyogenes*," Database Biosis, Biosciences Information Service, Database accession No. PREV200200585381, 2002 (Abstract).

Vittali et al., "PCR M typing: a new method for rapid typing of a group A streptococci," *J. Clin. Microbiol.*, 40:679-681, 2002.

Witnack & Beachey, "Inhibition of complement-mediated opsonization and phagocytosis of *Streptococcus pyogens* by D fragements of fibrinogen and fibrin bound to cell surface M protein," *J. Exp. Med.*, 162:1983-97, 1985.

Japanese Office Action, issued in Japanese Application No. 2006-505135, mailed Feb. 2, 2010 (English Translation).

* cited by examiner

```
                                                                                        90
TIGR4     MKKKILASLL LSTVMVSQVA VLTTAHAETT DDKIAAQDNK ISNLTAQQQE AQKQVDQIQE QVSAIQAEQS NLQAENDRLQ AESKKLEGEI
14        MKKKILASLL LSTVMVSQVA VLTTAHAETT DDKIAAQDNK ISNLTAQQQE AQKQVDQIQE QVSAIQAEQS NLQAENDRLQ AESKKLEGEI
19F       MKKKILASLL LSTVMVSQVA VLTTAHAETT DDKIAAQDNK ISNLTAQQQE AQKQVDQIQE QVSAIQAEQS NLQAENDRLQ AESKKLEGEI
Consensus mKKKILASLL LSTVMVSQVA VLTTAHAETT DDKIAAQDNK ISNLTAQQQE AQKQVDQIQE QVSAIQAEQS NLQAENDRLQ AESKKLEGEI 91                                                                            180
TIGR4     TELSKNIVSR NQSLEKQARS AQTNGAVTSY INTIVNSKSI TEAISRVAAM SEIVSANNKM LEQQKADKKA ISEKQVANND AINTVIANQQ
14        TELSKNIVSR NQSLEKQARS AQTNGAVTSY INTIVNSKSI TEAISRVAAM SEIVSANNKM LEQQKADKKA ISEKQVANND AINTVIANQQ
19F       TELSKNIVSR NQSLEKQARS AQTNGAVTSY INTIVNSKSI TEAISRVAAM SEIVSANNKM LEQQKADKKA ISEKQVANND AINTVIANQQ
Consensus TELSKNIVSR NQSLEKQARS AQTNGAVTSY INTIVNSKSI TEAISRVAAM SEIVSANNKM LEQQKADKKA ISEKQVANND AINTVIANQQ 181                                                                           270
TIGR4     KLADDAQALT TKQAELKAAE LSLAAEKATA EGEKASLLEQ KAAAEAEARA AAVAEAAYKE KRASQQQSVL ASANTNLTAQ VQAVSESAAA
14        KLADDAQALT TKQAELKAAE LSLAAEKATA EGEKASLLEQ KAAAEAEARA AAVAEAAYKE KRASQQQSVL ASANTNLTAQ VQAVSESAAA
19F       KLADDAQALT TKQAELKAAE LSLAAEKATA EGEKASLLEQ KAAAEAEARA AAVAEAAYKE KRAGQQQSVL ASANTNLTAQ VQAVSESAAA
Consensus KLADDAQALT TKQAELKAAE LSLAAEKATA EGEKASLLEQ KAAAEAEARA AAVAEAAYKE KRAsQQQSVL ASANTNLTAQ VQAVSESAAA 271                                                                           360
TIGR4     PVRAKVRPTY STNASSYPIG ECTWGVKTLA PWAGDYWGNG AQWATSAAAA GFRTGSTPQV GAIACWNDGG YGHVAVVTAV ESTTRIQVSE
14        PVRAKVRPTY STNASSYPIG ECTWGVKTLA PWAGDYWGNG AQWATSAAAA GFRTGSTPQV GAIACWNDGG YGHVAVVTAV ESTTRIQVSE
19F       PVRAKVRPTY STNASSYPIG ECTWGVKTLA PWAGDYWGNG AQWATSAAAA GFRTGSTPQV GAIACWNDGG YGHVAVVTAV ESTTRIQVSE
Consensus PVRAKVRPTY STNASSYPIG ECTWGVKTLA PWAGDYWGNG AQWATSAAAA GFRTGSTPQV GAIACWNDGG YGHVAVVTAV ESTTRIQVSE 361                      392
TIGR4     SNYAGNRTIG NHRGWFNPTT TSEGFVTYIY AD
14        SNYAGNRTIG NHRGWFNPTT TPEGFVTYIY AD
19F       SNYAGNRTIG NHRGWFNPTT TSEGFVTYIY AD
Consensus SNYAGNRTIG NHRGWFNPTT TsEGFVTYIy ad
```

Fig. 12

```
        1                                                                                   90
TIGR4   MIQIGKIFAG RYRIVKQIGR GGMADVYLAK DLILDGEEVA VKVLRTNYQT DPIAVARFQR EARAMADLDH PHIVRITDIG EEDGQQYLAM
4       MIQIGKIFAG RYRIVKQIGR GGMADVYLAK DLILDGEEVA VKVLRTNYQT DPIAVARFQR EARAMADLDH PHIVRITDIG EEDGQQYLAM
6B      MIQIGKIFAG RYRIVKQIGR GGMADVYLAK DLILDGEEVA VKVLRTNYQT DPIAVARFQR EARAMADLDH PHIVRITDIG EEDGQQYLAM
9V      MIQIGKIFAG RYRIVKQIGR GGMADVYLAK DLILDGEEVA VKVLRTNYQT DPIAVARFQR EARAMADLDH PHIVRITDIG EEDGQQYLAM
18C     MIQIGKIFAG RYRIVKQIGR GGMADVYLAK DLILDGEEVA VKVLRTNYQT DPIAVARFQR EARAMADLDH PHIVRITDIG EEDGQQYLAM
R6      MIQIGKIFAG RYRIVKQIGR GGMADVYLAK DLILDGEEVA VKVLRTNYQT DPIAVARFQR EARAMADLDH PHIVRITDIG EEDGQQYLAM 91                                                                                  180
TIGR4   EYVAGLDLKR YIKEHYPLSN EEAVRIMGQI LLAMRLAHTR GIVHRDLKPQ NILLTPDGTA KVTDFGIAVA FAETSLTQTN SMLGSVHYLS
4       EYVAGLDLKR YIKEHYPLSN EEAARIMGQI LLAMRLAHTR GIVHRDLKPQ NILLTPDGTA KVTDFGIAVA FAETSLTQTN SMLGSVHYLS
6B      EYVAGLDLKR YIKEHYPLSN EEAVRIMGQI LLAMRLAHTR GIVHRDLKPQ NILLTPDGTA KVTDFGIAVA FAETSLTQTN SMLGSVHYLS
9V      EYVAGLDLKR YIKEHYPLSN EEAVRIMGQI LLAMRLAHTR GIVHRDLKPQ NILLTPDGTA KVTDFGIAVA FAETSLTQTN SMLGSVHYLS
18C     EYVAGLDLKR YIKEHYPLSN EEAVRIMGQI LLAMRLAHTR GIVHRDLKPQ NILLTPDGTA KVTDFGIAVA FAETSLTQTN SMLGSVHYLS
R6      EYVAGLDLKR YIKEHYPLSN EEAVRIMGQI LLAMRLAHTR GIVHRDLKPQ NILLTPDGTA KVTDFGIAVA FAETSLTQTN SMLGSVHYLS 181                                                                                 270
TIGR4   PEQARGSKAT VQSDIYAMGI IFYEMLTGHI PYDGDSAVTI ALQHFQKPLP SVIAENPSVP SVIAENPSVP QALENVIIKA TAKKLTNRYR SVSEMYVDLS
4       PEQAGGSKAT VQSDIYAMGI IFYEMLTGHI PYDGDSAVTI ALQHFQKPLP SVIAENPSVP QALENVIIKA TAKKLTNRYR SVSEMYVDLS
6B      PEQARGSKAT VQSDIYAMGI IFYEMLTGHI PYDGDSAVTI ALQHFQKPLP SVIAENPSVP QALENVIIKA TAKKLTNRYR SVSEMYVDLS
9V      PEQARGSKAT VQSDIYAMGI IFYEMLTGHI PYDGDSAVTI ALQHFQKPLP SVIAERPSVP QALENVIIKA TAKKLTNRYR SVSEMYVDLS
18C     PEQARGSKAT VQSDIYAMGI IFYEMLTGHI PYDGDSAVTI ALQHFQNPLP SVIAENSSVP QALENVIRA TAKKLTNRYR SVSEMYVDLS
R6      PEQARGSKAT VQSDIYAMGI IFYEMLTGHI PYDGDSAVTI ALQHFQKPLP SVIAENPSVP QALENVIIKA TAKKLTNRYR SVSEMYVDLS 271                                                                                 360
TIGR4   SSLSYNRRNE SKLIFDETSK ADTKTLPKVS QSTLTSIPKV QAQTEHKSIK NPSQAVTEET YQPQAPKKHR FKMRYLILLA SLVLVAASLI
4       SSLSYNRRNE SKLIFDETSK ADTKTLPKVS QSTLTSIPKV QAQTEHKSIK NPSRAVTEET YQPQAPKKHR FKMRYLILLA SLVLVAASLI
6B      SSLSYNRRNE SKLIFDETSK ADTKTLPKVS QSTLTSIPKV QAQTEHKSIK NPSQAVTEET YQPQAPKKHR FKMRYLILLA SLVLVAASLI
9V      SSLSYNRRNE SKLIFDETSK ADTKTLPKVS QSTLTSIPKV QAQTEHKSIK NPSQAVTEET YQPQAPKKHR FKMRYLILLA SLVLVAASLI
18C     SSLSYNRRNE SKLIFDETSK ADTKTLPKVS QSTLTSIPKV QAQTGHKSIK NPSQAVTEET YQPQAPKKHR FKMRYLILLA SLVLVAASLI
R6      SSLSYNRRNE SKLIFDETSK ADTKTLPKVS QSTLTSIPKV QAQTEHKSIK NPSQAVTEET YQPQAPKKHR FKMRYLILLA SLVLVAASLI
```

Fig. 13A

```
        361
TIGR4   WILSRTPATI  AIPDVAGQTV  AEAKATLKKA  NFEIGEEKTE  ESNESEAGTV  LKQSLPEGTT  YDLSKATQIV  LTVAKKATTI  QLGNYIGRNS  TEVISELKQK  KVPENLIKIE  450
4       WILSRTPATI  AIPDVAGQTV  AEAKATLKKA  NFEIGEEKTE  ESNESEAGTV  LKQSLPEGTT  YDLSKATQI-  ----------  ----------  ----------  ----------
6B      WILSRTPATI  AIPDVAGQTV  AEAKATLKKA  NFEIGEEKTE  ESNESEAGTV  LKQSLPEGTT  YDLSKATQIV  LTVAKKATTI  QLGNYIGRNS  TEVISELKQK  KVPENLIKIE
9V      WILSRTPATI  AIPDVAGQTV  AEAKATLKKA  NFEIGEEKTE  ESNESEAGTV  LKQSLPEGTT  YDLSKATQIV  LTVAKKATTI  QLGNYIGRNS  TEVISELKQK  KVPENLIKIE
18C     WILSRTPATI  AIPDVAGQTV  AEAKATLKKA  NFEIGEEKTE  ESNESEAGTV  LKQSLPEGTT  YDLSKATQI<u>I</u>  LTVAKKATTI  QLGNYIGRNS  TEVISELKQK  KVPENLIKIE
R6      WILSRTPATI  AIPDVAGQTV  AEAKATLKKA  NFEIGEEKTE  ESNESEAGTV  LKQSLPEGTT  YDLSKATQIV  LTVAKKATTI  QLGNYIGRNS  TEVISELKQK  KVPENLIKIE

451
TIGR4   VIAELKEKKV  PDNLIKIEEE  TIMKQSPGAG  TTYDVSKPTQ  IVLTVAKKVT  SVAMPSYIGS  SLEFTKNNLI  QIVGIKEANI  EVVEVTTAPA  GSAEGMVVEQ  540
4       ----------  ----------  ----------  ----------  -VLTVAKKVT  SVAMPSYIGS  SLEFTKNNLI  QIVGIKEANI  EVVEVTTAPA  GSAEGMVVEQ
6B      VIAELKEKKV  PDNLIKIEEE  TIMKQSPGAG  TTYDVSKPTQ  IVLTVAKKVT  SVAMPSYIGS  SLEFTKNNLI  QIVGIKEANI  EVVEVTTAPA  GS<u>V</u>EGMVVEQ
9V      VIAELKEKKV  PDNLIKIEEE  TIMKQSPGAG  TTYDVSKPTQ  IVLTVAKKVT  SVAMPSYIGS  SLEFTKNNLI  QIVGIKEANI  EVVEVTTAPA  GSAEGMVVEQ
18C     VIAELKEKKV  PDNLIKIEEE  TIMKQSPGAG  TTYDVSKPTQ  IVLTVAKKVT  SVAMPSYIGS  SLEFTKNNLI  QIVGIKEANI  EVVEVTTAPA  GSAEGMVVEQ
R6      VIAELKEKKV  PDNLIKIEEE  TIMKQSPGAG  TTYDVSKPTQ  IVLTVAKKVT  SVAMPSYIGS  SLEFTKNNLI  QIVGIKEANI  EVVEVTTAPA  GS<u>V</u>EGMVVEQ 541                                                                                                                     630
TIGR4   EEESSESEPG  NKTRVKISIY  KPKTTSATP   659
4       EEESSESEPG  NKTRVKISIY  KPKTTSATP
6B      EEESSESEPG  NKTRVKISIY  KPKTTSATP
9V      EEESSESEPG  NKTRVK<u>T</u>SIY  KPKTTSATP
18C     EEESSESEPG  NKTRVKISIY  KPKTTSATP
R6      EEESSESEPG  NKTRVKISIY  KPKTTSATP

```
            1                                                                              90
TIGR4       MFASKSERKV HYSIRKFSVG VASVVVASLV MGSVVHATEN EGATQVPTSS NRANESQAEQ GEQPKKLDSE RDKARKEVEE YVKKIVGESY
R6          MFASKSERKV HYSIRKFSIG VASVAVASLV MGSVVHATEN EGSTQAATSS NMAKTEH--- ---------- RKAAKQVVDE YIEKMLRE--
4           MFASKSERKV HYSIRKFSVG VASVVVASLV MGSVVHATEN EGATQVPTSS NRANESQAEQ GEQPKKLDSE RDKARKEVEE YVKKIVGESY
9V          MFASKSERKV HYSIRKFSVG VASVAVASLV MGSVVHATEN ERTTQVPTSS NRGKPER--- ---------- RKAAEQF-DE YINKM-----
14          MFASKSERKV HYSIRKFSIG VASVAVASLF LGGVVHA-EG VRSENTPKVT SSGDE----- ---------- -------VDE YIKKMLSE--
18C         MFASKSERKV HYSIRKFSIG VASVAVASIV MGSVVHATEK EVTTQVPTYS NMAKTEH--- ---------- RKAAKQVVDE YIEKMLRE--
19F         MFASKSERKV HYSIRKFSIG VASVAVASLF LGGVVHA-EG VRSENTPKVT SSGDE----- ---------- -------VDE YIKKMLSE--
23F         MFASKSERKV HYSIRKFSIG VASVAVASLF MGSVVHATEK EVTTQVATSS NKANKSQ--- ---------- ------TE HMKAAKQVDE YIKKKL----
Consensus   MFASKSERKV HYSIRKFS!G VASVaVASlv $GsVVHAtE. e..t#vptss n.a.e..... .......... r..a...v#E Y!kKml.e..
            91                                                                             180
TIGR4       AKSTKKRHTI TVALVNELNN IKNEYLNKI- VESTSESQLQ ILMMESRSKV DEAVSKFEKD SSSSSSSDSS TKPEASDTAK PNKPTEPGEK
R6          IQLDRKKHTQ NVALNIKLSA IKTKYLREL- -NVLEEKSKD ELPSEIKAKL DAAFEKFKKD T--------- T--------- ----LKPGEK
4           AKSTKKRHTI TVALVNELNN IKNEYLNKI- VESTSESQLQ ILMMESRSKV DEAVSKFEKD SPSSSSSDSS TKPE------ ----------
9V          IQLDRKKHTQ NLAFNIQLSR IKTEYLNGL- -------KEKSEA ELPSKIKAEL ELTSKTKKEV DAAFKQFKKD TLPTEPE--- T--------- --KKVAEAEKK
14          IQLDRKKHTH NFALNLKLSR IKTEYLYKLK VNVLEEKSKA ELPSKIKAEL ELTSKTKKEV DAAFEKFKKD T--------- ---------- -----LKLGEK
18C         IQLDRKKHTH NFAFNMKLSA IKTEYLYGL- -------KEKSEA ELPSS-EAEL PSEVKA-KLD AAFEQFK--- ---------- ---------- -KDTLKLGEK
19F         IQLDRKKHTH NFALNLKLSR IKTEYLYKLK VNVLEEKSKA ELTSKTKKEV DAAFEKFKKD T--------- ---------- -----LKLGEK
23F         -QLDRRKHTQ NVGLLTKLGV IKTEYLHGL- -SVSKKKSEA ELPSEIKAKL DAAFEQFKKD TLP------- ---------- -----TEPGKK
Consensus   iqldkrkHT. n.aln.kLs. IKtEYL.kl. v...eks.a eL.s..k.ev daaf.kfkkD t......... ......... .......gek
            181                                                                            270
TIGR4       VAEAKKVEE AEKKAKDQKE EDRRNYPTIT YKTLELEIAE SDVEVKKAEL ELVKVKANEP RDEQKIKQAE AEVESKQAEA TRLKKIKTDR
R6          VAEAKKKVEE AKKKAEDQKE EDRRNYPTNT YKTLELEIAE FDVKVKEAEL ELVKREEAKES EKVESKKAEA TRLENIKTDR
9V          VEEAEKKVAE AKKKAKAQKE EDHRNYPTNT YKTLDLEIAE FDVRKVKEAEL ELVKKEADES AKVESEKAEA TRLKKIKTDR
14          VAEAQKKVEE AKKKAKDQKE EDRNYPTNT YKTLELEIAE SDVRVKEAEL ELLKEEA-KT RNEDTINQAK AKVKSEQAEA TRLKKIKTDR
18C         VAEAKKKVAE AKKKAKAQKE EDRNYPTNT YKTLELEIAE SDVRVKEAEL ELLKEEA-KT RNKDTIKQAK AKVESKKAEA TKLEEIKTDR
19F         VAEAQKKVEE AKKKAKDQKE EDRRNYPTNT YKTLELEIAE SDVRVKEAEL ELLKEEA-KT RNEDTINQAK AKVKSEQAEA TRLKKIKTDR
23F         VAEAKKKVEE AKKKAEDQKE KDLRNYPTNT YKTLELDIAE SDVEVKKAEL ELVKGSYRNL ETRKKLIKQS EKLRIKKLML Q
Consensus   vaea.kkvee akkkakdqke ed.rnypt.t yktleleiae sdv.vk.ael el.k.ea... rne.ti.qak akv.s..aea trl..iktdr
            271                                                                            360
TIGR4       EEAEEE-AKR RADAK----- ---EQGKPK GRAKRGVPGE LATPDKKEND AKSSDDSSVGE ETLPSPSLKP EKKVAEAEKK VEEAKKKAED
R6          KKAEEE-AKR KADAKLKEAN VATSDQGKPK GRAKRGVPGE LATPDKKEND AKSSDDSSVGE ETLPSSSLKS GKKVAEAEKK VEEAEKKAKD
9V          EKAEEEEAKR RADAKEQDES
14          EQAEAT
18C         KKAEEEA
19F         EQAEATRLEN IKTDREK--- ---AEEAKRK AE
Consensus   ..ae...... .......... .......... ..
```

Fig. 14A

```
            361                                                                                      450
TIGR4      QKEEDRRNYP TNTYKTLELE IAESDVEVKK AELELVKEEA KEPRNEEKVK QAKAEVESKK AEATRLEKIK TDRKKAEEEA KRKAAEEDKV
R6         QKEEDRRNYP TNTYKTLDLE IAESDVKVKE AELELVKEEA KEPRDEEKIK QAKAKVESKK AEATRLENIK TDRKKAEEEA KRKAAEEDKV
4                                 AESDVEVKK AELELVKEEA KEPRNEEKVK QAKAEVESKK AEATRLEKIK TDRKKAEEEA KRKAAEEDKV
6B                     LK         LLSPMWKLKK RSLTS-KEEA KKPLNEGTIR KKPLNEGTIR AEATRLEKIK TDRKKAEEEA KRRAAEEDKV
9V                                IAESDVKVKE AELELVKEEA KESRNEEKIK QAKAKVESKK AEATRLEKIK TDRKKAEEEA KRKAAEEDKV
14                                IAESDVKVKE AELELVKEEA KEPRDEEKIK QAKAKVESKQ AEATRLEKIK TDRKKAEEEA KRKAAEEDKV
18C                               IAESDVKVKE AELELVKEEA KESRNEEKVK QAKAKVESKK AEATRLEKIK TDRKKAEEEA KRKAAEEDKV
19F                               IAESDVKVKE AELELVKEEA KESRNEEKVK QAKAKVESKK AEATRLEKIK TDRKKAEE-A KRRAAEEDKV
23F                    LE         IAESDVKVKE AELELVKEEA KESRNEEKVK QAKAKVESKQ AEATRLEKIK TDRKKAEEEA KRKAAEEDKV
Consensus  .......... .......... iaesdvkvke aelelvkeea keprneek.k qaka.veskk aeatrlekik tdrkkaeeea krkaaeedkv 451                                                                                      540
TIGR4      KEKPAEQPQP APAPKAEKPA ---------- ----PAP KPENPAEQPK AEKPA---- ---DQQAEED YARRSEEEYN RLTQQQPPKT
R6         KEKPAEQPQP APATQPEKPA ---------- ----P--    KPEKPAEQPK AEKTD---- ---DQQAEED YARRSEEEYN RLTQQQPPKT
4          KEKPAEQPQP APAPKAEKP- ---------- ----APAP   KPENPAEQPK AEKPA---- ---DQQAEED YARRSEEEYN RLTQQQPPKT
6B         KEKPAEQPQP APAPQPEKPT EEPENPVPAP KPEKPAEQPK AEKPA---- KTDDQQAEED YARRSEEEYN RLTQQQPQKP
9V         KEKPAEQPQP APAPKPENPA EEPENPVPAP KPEKPAEQPK AEKPA---- ---DQQAEED YARRSEEEYN RLTQQQPPKP
14         KEKPAEQPQP APAPQPEKPT PKPEKPAPAP KPENPAEQPK AEKPA---- ---DQQAEED YARRSEEEYN RLTQQQPPKP
18C        KEKPAEQPQP APAPQPEKPT EEPENPAPAP KPEKPAEQPK AEKPA---- ---DQQAEED YARRSEEEYN RLTQQQPPKT
19F        KEKPAEQPQP APAPQPEKP- ---------- ----APAP   KPENPAEQPK AEKPA---- ---DQQAEED YARRSEEEYN RLTQQQPPKT
23F                                                                     VQNGMW YFYNTDGSMA TGWLQNNGSW
Consensus  kekpaeqpqp apapqpekp. .......... ....pap    kpenpaeqpk aekpa.... ...dqQaeed Yarrs#eeyn rltq#ppkt 541                                                                                      630
TIGR4      EKPAQPSTPK TGWKQENGMW YFYNTDGSMA TGWLQNNGSW YYLNSNGAMA YYLNANGSMA TGWLQNNGSW YYLNANGSMA
R6         EKPAQPSTPK TGWKQENGMW YFYNTDGSMA TGWLQNNGSW YYLNSNGAMA YYLNANGAMA TGWLQNNGSW YYLNANGAMA
4          EKPAQPSTPK TGWKQENGMW YFYNTDGSMA TGWLQNNGSW YYLNSNGAMA YYLNANGAMA TGWLQNNGSW YYLNANGAMA
6B         EQPAP--APK IGWKQENGMW YFYNTDGSMA TGWLQNNGSW YYLNSNGAMA YYLNANGDMA TGWLQNNGSW YYLNANGDMA
9V         EQPAP--APK IGWKQENGMW YFYNTDGSMA TGWLQNNGSW YYLNSNGAMA YYLNANGDMA TGWLQNNGSW YYLNANGDMA
14         EKPAQPSTPK TGWKQENGMW YFYNTDGSMA TGWLQ----- YYLNSNGAMA YYLNANGDMA TGWLQNNGSW YYLNANG---
18C        EKPAQPSTPK TGWKQENGMW YFYNTDGSMA TGWLQNNGSW YYLNSNGAMA YYLNANGDMA TGWLQYNGSW YYLNANG---
19F        EKPAQPSTPK TGWKQENGMW YFYNTDGSMA TGWLQNNGSW YYLNANGDMA TGWFQYNGSW YYLNANGDMA
23F        YYLNSNGAMA TGWLQNNGSW YYLNSNGAMA TGWLQNNGSW YYLNANGDMA TGWFQYNGSW YYLNANGDMA
Consensus  ekpaqpstpk tGWkQ#NGmW Y%yNt#GsMA TGWLQ.ngsw yyln.ng.ma tgwlqnngsw yylnang.ma
```

Fig. 14B

```
            631                                                                                              720
TIGR4       TGWLQYNGSW YYLN------ ---------- ---------- ---------- ----ANGSMA TGWLQYNGSW YYLNANGDMA TGWVKDGDTW
R6          TGWLQYNGSW YYLNSNGAMA TGWLQYNGSW YYLNANGDMA ---------- ---------- TGWLQYNGSW YYLNANGDMA TGWVKDGDTW
4           TGWLQYNGSW YYLN------ ---------- ---------- ---------- ----ANGSMA TGWLQYNGSW YYLNANGDMA TGWVKDGDTW
6B          ---------- ---------- ---------- ---------- ---------- -----YNGSW YYLNANGSMA TGWVKDGDTW
9V          TGWLQYNGSW YYLN------ ---------- ----ANGDMA TGWLQYNGSW YYLNANGDMA ---------- TGWLQNNGSW YYLNANGDMA TGWVKDGDTW
14          ---------- ---------- ---------- ---------- ---------- ------DMA TGWLQNNGSW YYLNANGDMA TGWVKDGDTW
18C         TGWLQYNGSW YYLN------ ---------- ---------- ---------- ----ANGDMA TGWLQNNGSW YYLNANGDMA TGWVKDGDTW
19F         ---------- ---------- ---------- ---------- ---------- ------DMA TGWLQNNGSW YYLNANGDMA TDWVKDGDTW
23F         TGWFQYNGSW YYLN------ ---------- ---------- ---------- ----ANGDMA TGWLQYNGSW YYLNSNGAMV TgWVKDGDTW
Consensus   tgw.qyngsw yyln                                           ngdma    tgwlqyNGSW YYLNANGdMA TgWVKDGDTW 721                                           769
TIGR4       YYLEASGAMK ASQWFKVSDK WYYVNGSGAL AVNTTVDGYG VNANGEWVN
R6          YYLEASGAMK ASQWFKVSDK WYYVNGSGAL AVNTTVDGYG VNANGEWVN
4           YYLEASGAMK ASQWFKVSDK WYYVNGSGAL AVNTTVDGYG VNANGEWVN
6B          YYLEASGAMK ASQWFKVSDK WYYVNGSGAL AVNTTVDGYG VNANGEWVN
9V          YYLEASGAMK ASQWFKVSDK WYYVNGSGAL AVNTTVDGYG VNANGEWVN
14          YYLEASGAMK ASQWFKVSDK WYYVNGSGAL AVNTTVDGYG VNANGEWVN
18C         YYLEASGAMK ASQWFKASDK WYYVNGSGAL AVNTTVDGYG VNANGEWVN
19F         YYLEASGAMK ASQWFKVSDK WYYVNGSGAL AVNTTVDGYG VNANGEWVN
23F         YYLEASGAMK ASQWFKASDK WYYVNGSGAL AVNTTVDSYR VNANGEWVN
Consensus   YYLEASGAMk asqwfkvsdk wyyvngsgal avnttvdgyg vnangewvn
```

Fig. 14C

S. PNEUMONIAE ANTIGENS

This application is a continuation of U.S. patent application Ser. No. 10/552,156 filed 11 Oct. 2005, now issued as U.S. Pat. No. 7,635,487, which is national phase application under 35 U.S.C. §371 of International Application No. PCT/EP2004/003984 filed 15 Apr. 2004, which claims priority to European Application No. 03450087.6 filed 15 Apr. 2003. The entire text of each of the above-referenced disclosures is specifically incorporated herein by reference without disclaimer.

The present invention relates to isolated nucleic acid molecules, which encode antigens for *Streptococcus pneumoniae*, which are suitable for use in preparation of pharmaceutical medicaments for the prevention and treatment of bacterial infections caused by *Streptococcus pneumoniae*.

*Streptococcus pneumoniae* (*Pneumococcus*) is a lancet-shaped, gram-positive, facultative anaerobic bacterium. It is only the encapsulated organism that is pathogenic for humans and experimental animals. Capsules are antigenic and form the basis for classifying pneumococci by serotypes. Ninety serotypes have been identified, based on their reaction with type-specific antisera. Most *S. pneumoniae* serotypes have been shown to cause serious disease, and the ten most common serotypes are estimated to account for about 62% of invasive disease worldwide. The ranking and serotype prevalence differs by age group and geographic area.

Pneumococci are common inhabitants of the respiratory tract, and may be isolated from the nasopharynx of 5% to 70% of normal adults. Rates of asymptomatic carriage vary with age, environment, and the presence of upper respiratory infections. Only 5%-10% of adults without children are carriers. In schools and orphanages, 27% to 58% of students and residents may be carriers. On military installations, as many as 50% to 60% of service personnel may be carriers. The duration of carriage varies and is generally longer in children than adults (reviewed in Epidemiology and Prevention of Vaccine-Preventable Diseases, 7th Edition-Second Printing, The Pink Book).

The relationship of carriage to the development of natural immunity is poorly understood. In addition, the immunologic mechanism that allows disease to occur in a carrier is poorly understood.

*Streptococcus pneumoniae* is an important agent of human disease at the extremities of age and in those who have underlying disease. Pneumococcal disease kills more people—in the US 40,000 or more each year—than all other vaccine preventable diseases combined. The major clinical syndromes of pneumococcal disease include pneumonia, bacteremia, and meningitis. The disease most often occurs when a predisposing condition exists, particularly pulmonary disease. It is a common bacterial complication of antecedent viral respiratory infection such as influenza and measles, and of chronic conditions such as chronic obstructive pulmonary disease, diabetes, congestive heart failure, renal failure, smoking and alcoholism. Pneumococcal infections are more common during the winter and in early spring when respiratory diseases are more prevalent. Immunodeficiency (splenic dysfunction, iatrogen, etc.) is a risk factor for development of fatal pneumococcal infections, because of decreased bacterial clearance and lack of antibodies. The incubation period is short, 1-3 days. Symptomes include an abrupt onset of fever and shaking chills or rigor, productive cough, pleuritic chest pain, dyspnoe, tachycardia and hypoxia.

*S. pneumoniae* is responsible for 88% of bacteremia infections in the US. Pneumonia is the most common form of invasive pneumococcal diseases: 150.000-570.000 cases per year (US). 36% of adult community-acquired and 50% of hospital-acquired pneumonia is caused by *S. pneumoniae* (US). The incidence of disease among adults aged 65 years and older has been reported to be ~60 cases/100.000. Case fatality rates for this disease increase from 1.4% for those aged two or younger to as high as 20.6% among those aged 80 or older. Diseases caused by influenza and *Pneumococcus* are together the fifth leading cause of death for persons aged 65 and older. Mortality attributable to these pathogens is more than 90% in this age group. Bacteremia occurs in about 25-30% of patients with pneumonia. The overall mortality rate of bacteremia is about 20%, but may be as high as 60% in elderly people. In 1998, 51% of all deaths attributable to invasive pneumococcal diseases occurred in age group above 65 years. Pneumococci cause 13%-19% of all cases of bacterial meningitis in the United States. An estimated 3,000 to 6,000 cases of pneumococcal meningitis occur each year. One-quarter of patients with pneumococcal meningitis also have pneumonia. The clinical symptoms, spinal fluid profile and neurologic complications are similar to other forms of purulent bacterial meningitis (reviewed in Epidemiology and Prevention of Vaccine-Preventable Diseases, 7th Edition-Second Printing, The Pink Book).

In children, Pneumococci are a common cause of acute otitis media, and are detected in 28%-55% of middle ear aspirates. By age 12 months, 62% of children have had at least one episode of acute otitis media. Middle ear infections are the most frequent reasons for pediatric office visits in the United States, resulting in over 20 million visits annually. Complications of pneumococcal otitis media may include mastoiditis and meningitis. Bacteremia without a known site of infection is the most common invasive clinical presentation among children <2 years of age, accounting for approximately 70% of invasive disease in this age group. Bacteremic pneumonia accounts for 12%-16% of invasive pneumococcal disease among children <2 years of age. With the decline of invasive Hib disease, *S. pneumoniae* has become the leading cause of bacterial meningitis among children <5 years of age in the United States. Children <1 year have the highest rates of pneumococcal meningitis, approximately 10 cases per 100,000 population. The burden of pneumococcal disease among children <5 years of age is significant. An estimated 17,000 cases of invasive disease occur each year, of which 13,000 are bacteremia without a known site of infection and about 700 are of meningitis. An estimated 200 children die every year as a result of invasive pneumococcal disease. Although not considered invasive disease, an estimated 5 million cases of acute otitis media occur each year among children <5 years of age (reviewed Epidemiology and Prevention of Vaccine-Preventable Diseases, 7th Edition-Second Printing, The Pink Book).

A definitive diagnosis of infection with *Streptococcus pneumoniae* generally relies on isolation of the organism from blood or other normally sterile body sites. Tests are also available to detect capsular polysaccharide antigen in body fluids.

Penicillin is the drug of choice for treatment. However, successful implementation of anti-infective therapy has become increasingly difficult because of widespread antimicrobial resistance. Resistance to penicillin is rising, and according to recent reports it reaches ~25% in the US {Whitney, C. et al., 2000}. The proportion of macrolide-resistant strains reached ~20% {Hyde, T. et al., 2001}. Use of antimicrobial agents is highly correlated with the increase in resistance of *S. pneumoniae* to -lactams and macrolides {McCormick, A. et al., 2003}.

However, even with effective antibiotic therapy (sensitive strains), the case fatality rate of invasive disease is high with an average of 10% in the developed world and can be much higher with certain serotypes, in elderly patients and in cases of bacteremia or meningitis (up to 80%).

Thus, there remains a need for an effective treatment to prevent or ameliorate spneumoocccal infections. A vaccine could not only prevent infections by streptococci, but more specifically prevent or ameliorate colonization of host tissues (esp. in nasopharynx), thereby reducing the incidence of upper respiratory infections and other suppurative infections, such otitis media. Elimination of invasive diseases—pneumonia, bacteremia and meningitis, and sepsis—would be a direct consequence of reducing the incidence of acute infection and carriage of the organism. Vaccines capable of showing cross-protection against the majority of S. pneumoniae strains causing human infections would also be useful to prevent or ameliorate infections caused by all other streptococcal species, namely groups A, B, C and G.

A vaccine can contain a whole variety of different antigens. Examples of antigens are whole-killed or attenuated organisms, subfractions of these organisms/tissues, proteins, or, in their most simple form, peptides. Antigens can also be recognized by the immune system in form of glycosylated proteins or peptides and may also be or contain polysaccharides or lipids. Short peptides can be used since for example cytotoxic T-cells (CTL) recognize antigens in form of short usually 8-11 amino acids long peptides in conjunction with major histocompatibility complex (MHC). B-cells can recognize linear epitopes as short as 4-5 amino acids, as well as three-dimensional structures (conformational epitopes). In order to obtain sustained, antigen-specific immune responses, adjuvants need to trigger immune cascades that involve all cells of the immune system. Primarily, adjuvants are acting, but are not restricted in their mode of action, on so-called antigen presenting cells (APCs). These cells usually first encounter the antigen(s) followed by presentation of processed or unmodified antigen to immune effector cells. Intermediate cell types may also be involved. Only effector cells with the appropriate specificity are activated in a productive immune response. The adjuvant may also locally retain antigens and co-injected other factors. In addition the adjuvant may act as a chemoattractant for other immune cells or may act locally and/or systemically as a stimulating agent for the immune system.

Efforts to develop effective pneumococcal vaccines began as early as 1911. However, with the advent of penicillin in the 1940s, interest in the vaccine declined, until it was observed that many patients still died despite antibiotic treatment. By the late 60s, efforts were again being made to develop a polyvalent vaccine. The first pneumococcal vaccines contained purified capsular polysaccharide antigen from 14 different types of pneumococcal bacteria. In 1983, a 23-valent polysaccharide vaccine (PPV23) was licensed and replaced the 14-valent vaccine, which is no longer produced. PPV23 contains polysaccharide antigen from 23 types of pneumococcal bacteria which cause 88% of bacteremic pneumococcal disease. In addition, cross-reactivity occurs for several capsular types which account for an additional 8% of bacteremic disease. Two polysaccharide vaccines are available in the United States (Pneumovax 23, Merck, and Pnu-Immune 23, Wyeth-Lederle). Both vaccines contain 25 µg of each antigen per dose and include either phenol or thimerosal as a preservative.

The first pneumococcal conjugate vaccine (PCV7, Prevnar) was licensed in the United States in 2000. It includes purified capsular polysaccharide of 7 serotypes of S. pneumoniae (4, 9V, 14, 19F, 23F, 18C, and 6B) conjugated to a nontoxic variant of diphtheria toxin known as CRM197. The serotypes included in Prevnar accounted for 86% of bacteremia, 83% of meningitis, and 65% of acute otitis media among children <6 years of age in the United States during 1978-1994 (reviewed in Epidemiology and Prevention of Vaccine-Preventable Diseases, 7th Edition-Second Printing, The Pink Book). Additional pneumococcal polysaccharide conjugate vaccines containing 9 and 11 serotypes of S. pneumoniae are being developed. The vaccine is administered intramuscularly. After 4 doses of Prevnar vaccine, virtually all healthy infants develop antibody to all 7 serotypes contained in the vaccine. Prevnar has also been shown to be immunogenic in infants and children, including those with sickle cell disease and HIV infection. In a large clinical trial, Prevnar was shown to reduce invasive disease caused by vaccine serotypes, and reduce invasive disease caused by all serotypes, including serotypes not in the vaccine. Children who received Prevnar had fewer episodes of acute otitis media and underwent fewer tympanostomy tube placements than unvaccinated children. The duration of protection following Prevnar is currently unknown Immunization with Prevnar reduces the rate of nasopharyngeal carriage of the vaccine serotypes, while the overall carriage rate is unaffected. Unfortunately, it has also been shown to induce serotype redistribution, that is the replacement of vaccine serotypes by strains, which are not covered by Prevnar {Pelton, S. et al., 2003}.

Pneumococcal vaccine is recommended to be administered routinely to i., all children as part of the routine childhood immunization schedule, ii., adults 65 years of age and older and iii., persons aged >2 years with normal immune systems who have chronic illnesses, including cardiovascular disease, pulmonary disease, diabetes, alcoholism, cirrhosis, or cerebrospinal fluid leaks. In the elderly population the target groups for pneumococcal vaccine and influenza vaccine overlap. These vaccines can be given at the same time at different sites without increased side effects.

High mortality is observed among high-risk individuals (with underlying disease—mainly viral respiratory infection, immunocompromise) even with effective antibiotic therapy. The mAb approach targets patients with serious disease and provides immediate immune enhancement for the clearance of the bacteria. Through opsonization bacteria are killed within phagocytic cells and not lysed in the blood by antibiotics. This mechanism of action can help to eliminate the release of toxins (such as pneumolysin and other cytotoxins), which worsen the clinical condition of septic patients. Recent advances in the technology of monoclonal antibody production provide the means to generate human antibody reagents and reintroduce antibody therapies, while avoiding the toxicities associated with serum therapy Immunoglobulins are an extremely versatile class of antimicrobial proteins that can be used to prevent and treat emerging infectious diseases. Antibody therapy has been effective against a variety of diverse microorganisms reviewed in {Burnie, J. et al., 1998}.

Although capsular specific antibodies have been shown to be highly protective, it remains unclear what concentration of these serotype-specific antibodies protect against disease and more recently it has become clear that opsonic activity and avidity of these antibodies are more critical determinants of protection than concentration.

Protein conjugate vaccines are no doubt a great new addition to the amarmatorium in the battle against pneumococcal disease, but the vaccine contains a limited number of pneumococcal serotypes and given adequate ecological pressure, replacement disease by non-vaccine serotypes remains a real threat, particularly in areas with very high disease burden.

During the last decade the immunogenicity and protective capacity of several pneumococcal proteins have been described in animal models and these are now being explored for the development of species-common protein based vaccines. Such proteins are the Pneumococcal surface protein A (PspA, {McDaniel, L. et al., 1991}; {Roche, H. et al., 2003}), Pneumococcal surface adhesin A (PsaA, {Talkington, D. et al., 1996}), Choline binding protein A (CbpA, {Rosenow, C. et al., 1997}), LytB glucosaminidase, LytC muramidase, PrtA serine protease, PhtA (histidine triad A) and Pneumococcal vaccine antigen A (PvaA) {Wizemann, T. et al., 2001}; {Adamou, J. et al., 2001}.

Certain proteins or enzymes displayed on the surface of gram-positive organisms significantly contribute to pathogenesis, and might be involved in the disease process caused by these pathogens. Often, these proteins are involved in direct interactions with host tissues or in concealing the bacterial surface from the host defense mechanisms {Navarre, W. et al., 1999}. S. pneumoniae is not an exception in this regard. Several surface proteins are characterized by as virulence factors, important for pneumococcal pathogenicity reviewed in {Jedrzejas, M., 2001}. If antibodies to these proteins could offer better protection to humans, they could provide the source of a novel, protein-based pneumococcal vaccine to be used in conjunction with or in place of the more traditional capsular polysaccharide vaccine. The use of some of the above-described proteins as antigens for a potential vaccine as well as a number of additional candidates reviewed in {Di Guilmi, A. et al., 2002} resulted mainly from a selection based on easiness of identification or chance of availability. There is a demand to identify relevant antigens for S. pneumoniae in a more comprehensive way.

The present inventors have developed a method for identification, isolation and production of hyperimmune serum reactive antigens from a specific pathogen, especially from Staphylococcus aureus and Staphylococcus epidermidis (WO 02/059148). However, given the differences in biological property, pathogenic function and genetic background, Streptococcus pneumoniae is distinctive from Staphylococcus strains Importantly, the selection of sera for the identification of antigens from S. pneumoniae is different from that applied to the S. aureus screens. Three major types of human sera were collected for that purpose. First, healthy adults below <45 years of age preferably with small children in the household were tested for nasopharyngeal carriage of S. pneumoniae. A large percentage of young children are carriers of S. pneumoniae, and they are considered to be a source for exposure for their family members. Based on correlative data, protective (colonization neutralizing) antibodies are likely to be present in exposed individuals (children with high carriage rate in the household) who are not carriers of S. pneumoniae. To be able to select for relevant serum sources, a series of ELISAs measuring anti-S. pneumoniae IgG and IgA antibody levels were performed with bacterial lysates and culture supernatant proteins. Sera from high titer non-carriers were included in the genomic-based antigen identification. This approach for selection of human sera is basically very different from that used for S. aureus, where carriage or non-carriage state couldn't be associated with antibody levels. Second, serum samples from convalescent phase patients with invasive pneumococcal diseases were characterized and selected in the same way. The third group of sera, containing longitudinally collected samples were also obtained from individuals with invasive disease and were used mainly for validation purposes. The main value of this collection is that one can follow the changes in antigen-specific antibody levels before diase (prae-), at the time of onset (acute) and during recovery (convalescent). This latter group helps in the selection of epitopes, which induce antibodies during disease and missing in the prae-disease state.

The genomes of the two bacterial species S. pneumoniae and S. aureus by itself show a number of important differences. The genome of S. pneumoniae contains app. 2.16 Mb, while S. aureus harbours 2.85 Mb. They have an average GC content of 39.7 and 33%, respectively and approximately 30 to 45% of the encoded genes are not shared between the two pathogens. In addition, the two bacterial species require different growth conditions and media for propagation. While S. pneumoniae is a strictly human pathogen, S. aureus can also be found infecting a range of warm-blooded animals. A list of the most important diseases, which can be inflicted by the two pathogens is presented below. S. aureus causes mainly nosocomial, opportunistic infections: impetigo, folliculitis, abscesses, boils, infected lacerations, endocarditis, meningitis, septic arthritis, pneumonia, osteomyelitis, scalded skin syndrome (SSS), toxic shock syndrome. S. pneumoniae causes mainly community acquired infections: upper (pharyngitis, otitis media) and and lower respiratory infections (pneumonia), as well as bacteremia, sepsis and meningitis.

The complete genome sequence of a capsular serotype 4 isolate of S. pneumoniae, designated TIGR4 was determined by the random shotgun sequencing strategy (GenBank accession number AE005672; see www.tigr.org/tigrscripts/CMR2/CMRHomePage.spl). This clinical isolate was taken from the blood of a 30-year-old male patient in Kongsvinger, Norway, and is highly invasive and virulent in a mouse model of infection.

The problem underlying the present invention was to provide means for the development of medicaments such as vaccines against S. pneumoniae infection. More particularly, the problem was to provide an efficient, relevant and comprehensive set of nucleic acid molecules or hyperimmune serum reactive antigens from S. pneumoniae that can be used for the manufacture of said medicaments.

Therefore, the present invention provides an isolated nucleic acid molecule encoding a hyperimmune serum reactive antigen or a fragment thereof comprising a nucleic acid sequence, which is selected from the group consisting of:
   a) a nucleic acid molecule having at least 70% sequence identity to a nucleic acid molecule selected from Seq ID No 1, 101-144.
   b) a nucleic acid molecule which is complementary to the nucleic acid molecule of a),
   c) a nucleic acid molecule comprising at least 15 sequential bases of the nucleic acid molecule of a) or b)
   d) a nucleic acid molecule which anneals under stringent hybridisation conditions to the nucleic acid molecule of a), b), or c)
   e) a nucleic acid molecule which, but for the degeneracy of the genetic code, would hybridise to the nucleic acid molecule defined in a), b), c) or d).

According to a preferred embodiment of the present invention the sequence identity is at least 80%, preferably at least 95%, especially 100%.

Furthermore, the present invention provides an isolated nucleic acid molecule encoding a hyperimmune serum reactive antigen or a fragment thereof comprising a nucleic acid sequence selected from the group consisting of
   a) a nucleic acid molecule having at least 96% sequence identity to a nucleic acid molecule selected from Seq ID No 2-6, 8, 10-16, 18-23, 25-31, 34, 36, 38-42, 44, 47-48, 51, 53, 55-62, 64, 67, 71-76, 78-79, 81-94, 96-100.
   b) a nucleic acid molecule which is complementary to the nucleic acid molecule of a), c) a nucleic acid molecule comprising at least 15 sequential bases of the nucleic acid molecule of a) or b)

d) a nucleic acid molecule which anneals under stringent hybridisation conditions to the nucleic acid molecule of a), b) or c), e) a nucleic acid molecule which, but for the degeneracy of the genetic code, would hybridise to the nucleic acid defined in a), b), c) or d).

According to another aspect, the present invention provides an isolated nucleic acid molecule comprising a nucleic acid sequence selected from the group consisting of a) a nucleic acid molecule selected from Seq ID No 9, 17, 24, 32, 37, 43, 52, 54, 65-66, 70, 80.

b) a nucleic acid molecule which is complementary to the nucleic acid of a), c) a nucleic acid molecule which, but for the degeneracy of the genetic code, would hybridise to the nucleic acid defined in a), b), c) or d).

Preferably, the nucleic acid molecule is DNA or RNA.

According to a preferred embodiment of the present invention, the nucleic acid molecule is isolated from a genomic DNA, especially from a *S. pneumoniae* genomic DNA.

According to the present invention a vector comprising a nucleic acid molecule according to any of the present invention is provided.

In a preferred embodiment the vector is adapted for recombinant expression of the hyperimmune serum reactive antigens or fragments thereof encoded by the nucleic acid molecule according to the present invention.

The present invention also provides a host cell comprising the vector according to the present invention.

According to another aspect the present invention further provides a hyperimmune serum-reactive antigen comprising an amino acid sequence being encoded by a nucleic acid molecule according to the present invention.

In a preferred embodiment the amino acid sequence (polypeptide) is selected from the group consisting of Seq ID No 145, 245-288.

In another preferred embodiment the amino acid sequence (polypeptide) is selected from the group consisting of Seq ID No 146-150, 152, 154-160, 162-167, 169-175, 178, 180, 182-186, 188, 191-192, 195, 197, 199-206, 208, 211, 215-220, 222-223, 225-238, 240-244.

In a further preferred embodiment the amino acid sequence (polypeptide) is selected from the group consisting of Seq ID No 153, 161, 168, 176, 181, 187, 196, 198, 209-210, 214, 224.

According to a further aspect the present invention provides fragments of hyperimmune serum-reactive antigens selected from the group consisting of peptides comprising amino acid sequences of column "predicted immunogenic aa" and "location of identified immunogenic region" of Table 1; the serum reactive epitopes of Table 2, especially peptides comprising amino acids 4-11, 35-64, 66-76, 101-108, 111-119 and 57-114 of Seq ID No 145; 5-27, 32-64, 92-102, 107-113, 119-125, 133-139, 148-162, 177-187, 195-201, 207-214, 241-251, 254-269, 285-300, 302-309, 317-324, 332-357, 365-404, 411-425, 443-463, 470-477, 479-487, 506-512, 515-520, 532-547, 556-596, 603-610, 616-622, 624-629, 636-642, 646-665, 667-674, 687-692, 708-720, 734-739, 752-757, 798-820, 824-851, 856-865 and 732-763 of Seq ID No 146; 14-21, 36-44, 49-66, 102-127, 162-167, 177-196, 45-109 and 145-172 of Seq ID No 147; 17-35, 64-75, 81-92, 100-119, 125-172, 174-183, 214-222, 230-236, 273-282, 287-303, 310-315, 331-340, 392-398, 412-420, 480-505, 515-523, 525-546, 553-575, 592-598, 603-609, 617-625, 631-639, 644-651, 658-670, 681-687, 691-704, 709-716, 731-736, 739-744, 750-763, 774-780, 784-791, 799-805, 809-822, 859-870, 880-885, 907-916, 924-941, 943-949, 973-986, 1010-1016, 1026-1036, 1045-1054, 1057-1062, 1082-1088, 1095-1102, 1109-1120, 1127-1134, 1140-1146, 1152-1159, 1169-1179, 1187-1196, 1243-1251, 1262-1273, 1279-1292, 1306-1312, 1332-1343, 1348-1364, 1379-1390, 1412-1420, 1427-1436, 1458-1468, 1483-1503, 1524-1549, 1574-1588, 1614-1619, 1672-1685, 1697-1707, 1711-1720, 1738-1753, 1781-1787, 1796-1801, 1826-1843, 132-478, 508-592 and 1753-1810 of Seq ID No 148; 15-43, 49-55, 71-77, 104-110, 123-130, 162-171, 180-192, 199-205, 219-227, 246-254, 264-270, 279-287, 293-308, 312-322, 330-342, 349-356, 369-377, 384-394, 401-406, 416-422, 432-439, 450-460, 464-474, 482-494, 501-508, 521-529, 536-546, 553-558, 568-574, 584-591, 602-612, 616-626, 634-646, 653-660, 673-681, 688-698, 705-710, 720-726, 736-749, 833-848, 1-199, 200-337, 418-494 and 549-647 of Seq ID No 149; 9-30, 65-96, 99-123, 170-178 and 1-128 of Seq ID No 150; 7-32, 34-41, 96-106, 127-136, 154-163, 188-199, 207-238, 272-279, 306-312, 318-325, 341-347, 353-360, 387-393, 399-406, 434-440, 452-503, 575-580, 589-601, 615-620, 635-640, 654-660, 674-680, 696-701, 710-731, 1-548 and 660-691 of Seq ID No 151; 4-19, 35-44, 48-59, 77-87, 93-99, 106-111, 130-138, 146-161 and 78-84 of Seq ID No 152; 24-30, 36-43, 64-86, 93-99, 106-130, 132-145, 148-165, 171-177, 189-220, 230-249, 251-263, 293-300, 302-312, 323-329, 338-356, 369-379, 390-412 and 179-193 of Seq ID No 153; 30-39, 61-67, 74-81, 90-120, 123-145, 154-167, 169-179, 182-197, 200-206, 238-244, 267-272 and 230-265 of Seq ID No 154; 14-20, 49-65, 77-86 and 2-68 of Seq ID No 155; 4-9, 26-35, 42-48, 53-61, 63-85, 90-101, 105-111, 113-121, 129-137, 140-150, 179-188, 199-226, 228-237, 248-255, 259-285, 299-308, 314-331, 337-343, 353-364, 410-421, 436-442 and 110-144 of Seq ID No 156; 36-47, 55-63, 94-108, 129-134, 144-158, 173-187, 196-206, 209-238, 251-266, 270-285, 290-295, 300-306, 333-344, 346-354, 366-397, 404-410, 422-435, 439-453, 466-473, 515-523, 529-543, 554-569, 571-585, 590-596, 607-618, 627-643, 690-696, 704-714, 720-728, 741-749, 752-767, 780-799, 225-247 and 480-507 of Seq ID No 157; 16-25, 36-70, 80-93, 100-106 and 78-130 of Seq ID No 158; 18-27, 41-46, 50-57, 65-71, 79-85, 93-98, 113-128, 144-155, 166-178, 181-188, 201-207, 242-262, 265-273, 281-295, 303-309, 318-327 and 36-64 of Seq ID No 159; 7-29, 31-44, 50-59, 91-96, 146-153, 194-201, 207-212, 232-238, 264-278, 284-290, 296-302, 326-353, 360-370, 378-384, 400-405, 409-418, 420-435, 442-460, 499-506, 529-534, 556-562, 564-576, 644-651, 677-684, 687-698, 736-743, 759-766, 778-784, 808-814, 852-858, 874-896, 920-925, 929-935, 957-965, 1003-1012, 1021-1027, 1030-1044, 1081-1087, 1101-1111, 1116-1124, 1148-1159, 1188-1196, 1235-1251, 1288-1303, 1313-1319, 1328-1335, 1367-1373, 1431-1437, 1451-1458, 1479-1503, 1514-1521, 1530-1540, 1545-1552, 1561-1568, 1598-1605, 1617-1647, 1658-1665, 1670-1676, 1679-1689, 1698-1704, 1707-1713, 1732-1738, 1744-1764, 1-70, 154-189, 922-941, 1445-1462 and 1483-1496 of Seq ID No 160; 6-51, 81-91, 104-113, 126-137, 150-159, 164-174, 197-209, 215-224, 229-235, 256-269, 276-282, 307-313, 317-348, 351-357, 376-397, 418-437, 454-464, 485-490, 498-509, 547-555, 574-586, 602-619 and 452-530 of Seq ID No 161; 25-31, 39-47, 49-56, 99-114, 121-127, 159-186, 228-240, 253-269, 271-279, 303-315, 365-382, 395-405, 414-425, 438-453 and 289-384 of Seq ID No 162; 9-24, 41-47, 49-54, 68-78, 108-114, 117-122, 132-140, 164-169, 179-186, 193-199, 206-213, 244-251, 267-274, 289-294, 309-314, 327-333, 209-249 and 286-336 of Seq ID No 163; 9-28, 53-67, 69-82, 87-93, 109-117, 172-177, 201-207, 220-227, 242-247, 262-268, 305-318, 320-325 and 286-306 of Seq ID No 164; 4-10, 26-39, 47-58, 63-73, 86-96, 98-108, 115-123, 137-143, 148-155, 160-176, 184-189, 194-204, 235-240, 254-259, 272-278 and 199-283 of Seq ID No 165; 4-26, 33-39, 47-53, 59-65, 76-83, 91-97, 104-112, 118-137, 155-160, 167-174, 198-207, 242-268, 273-279, 292-315, 320-332, 345-354, 358-367, 377-394, 403-410, 424-439, 445-451, 453-497, 511-518, 535-570, 573-589, 592-601, 604-610 and 202-242 of Seq ID No 166; 8-30, 36-45, 64-71, 76-82, 97-103, 105-112, 134-151, 161-183, 211-234, 253-268, 270-276, 278-284, 297-305, 309-315, 357-362, 366-372, 375-384, 401-407, 409-416, 441-455, 463-470, 475-480, 490-497, 501-513, 524-537, 552-559, 565-576, 581-590, 592-600, 619-625, 636-644, 646-656 and 316-419 of Seq ID No 167; 4-17, 52-58, 84-99, 102-110, 114-120, 124-135, 143-158, 160-173, 177-196, 201-216, 223-250, 259-267, 269-275 and 1-67 of Seq ID No 168; 6-46, 57-67, 69-80, 82-133, 137-143, 147-168, 182-187, 203-209, 214-229, 233-242, 246-280 and 53-93 of Seq ID No 169; 7-40, 50-56, 81-89, 117-123, 202-209, 213-218, 223-229, 248-261, 264-276, 281-288, 303-308, 313-324, 326-332, 340-346, 353-372, 434-443, 465-474, 514-523, 556-564, 605-616, 620-626, 631-636, 667-683, 685-699, 710-719, 726-732, 751-756, 760-771, 779-788, 815-828, 855-867, 869-879, 897-902, 917-924, 926-931, 936-942, 981-1000, 1006-1015, 1017-1028, 1030-1039, 1046-1054, 1060-1066, 1083-1092, 1099-1112, 1122-1130, 1132-1140, 1148-1158, 1161-1171, 1174-1181, 1209-1230, 1236-1244, 1248-1254, 1256-1267, 1269-1276, 1294-1299, 1316-1328, 1332-1354, 1359-1372, 1374-1380, 1384-1390, 1395-1408, 1419-1425, 1434-1446, 1453-1460, 1465-1471, 1474-1493, 1505-1515, 1523-1537, 1547-1555, 1560-1567, 1577-1605, 1633-1651, 1226-1309, 1455-1536 and 1538-1605 of Seq ID No 170; 4-10, 31-39, 81-88, 106-112, 122-135, 152-158, 177-184, 191-197, 221-227, 230-246, 249-255, 303-311, 317-326, 337-344, 346-362, 365-371, 430-437, 439-446, 453-462, 474-484 and 449-467 of Seq ID No 171; 9-15, 24-35, 47-55, 122-128, 160-177, 188-196, 202-208, 216-228, 250-261, 272-303, 318-324, 327-339, 346-352, 355-361, 368-373, 108-218 and 344-376 of Seq ID No 172; 6-14, 17-48, 55-63, 71-90, 99-109, 116-124, 181-189, 212-223, 232-268, 270-294, 297-304, 319-325, 340-348, 351-370, 372-378, 388-394, 406-415, 421-434 and 177-277 of Seq ID No 173; 21-39, 42-61, 65-75, 79-85, 108-115 and 11-38 of Seq ID No 174; 4-17, 26-39, 61-76, 103-113, 115-122, 136-142, 158-192, 197-203, 208-214, 225-230, 237-251 and 207-225 of Seq ID No 175; 5-11, 27-36, 42-53, 62-70, 74-93, 95-104, 114-119, 127-150, 153-159, 173-179, 184-193, 199-206, 222-241, 248-253, 257-280, 289-295, 313-319, 322-342, 349-365, 368-389, 393-406, 408-413, 426-438, 447-461, 463-470, 476-495, 532-537, 543-550 and 225-246 of Seq ID No 176; 4-29, 68-82, 123-130, 141-147, 149-157, 178-191, 203-215, 269-277, 300-307, 327-335, 359-370, 374-380, 382-388, 393-400, 410-417, 434-442, 483-492, 497-503, 505-513, 533-540, 564-569, 601-607, 639-647, 655-666, 693-706, 712-718, 726-736, 752-758, 763-771, 774-780, 786-799, 806-812, 820-828, 852-863, 884-892, 901-909, 925-932, 943-948, 990-996, 1030-1036, 1051-1059, 1062-1068, 1079-1086, 1105-1113, 1152-1162, 1168-1179, 1183-1191, 1204-1210, 1234-1244, 1286-1295, 1318-1326, 1396-1401, 1451-1460, 1465-1474, 1477-1483, 1488-1494, 1505-1510, 1514-1521, 1552-1565, 1593-1614, 1664-1672, 1677-1685, 1701-1711, 1734-1745, 1758-1770, 1784-1798, 1840-1847, 1852-1873, 1885-1891, 1906-1911, 1931-1939, 1957-1970, 1977-1992, 2014-2020, 2026-2032, 2116-2134, 1-348, 373-490, 573-767, 903-1043, 1155-1198, 1243-1482, 1550-1595, 1682-1719, 1793-1921 and 2008-2110 of Seq ID No 177; 10-35, 39-52, 107-112, 181-188, 226-236, 238-253, 258-268, 275-284, 296-310, 326-338, 345-368, 380-389, 391-408, 410-418, 420-429, 444-456, 489-505, 573-588, 616-623, 637-643, 726-739, 741-767, 785-791, 793-803, 830-847, 867-881, 886-922, 949-956, 961-980, 988-1004, 1009-1018, 1027-1042, 1051-1069, 1076-1089, 1108-1115, 1123-1135, 1140-1151, 1164-1179, 1182-1191, 1210-1221, 1223-1234, 1242-1250, 1255-1267, 1281-1292, 1301-1307, 1315-1340, 1348-1355, 1366-1373, 1381-1413, 1417-1428, 1437-1444, 1453-1463, 1478-1484, 1490-1496, 1498-1503, 1520-1536, 1538-1546, 1548-1570, 1593-1603, 1612-1625, 1635-1649, 1654-1660, 1670-1687, 1693-1700, 1705-1711, 1718-1726, 1729-1763, 1790-1813, 1871-1881, 1893-1900, 1907-1935, 1962-1970, 1992-2000, 2006-2013, 2033-2039, 2045-2051, 2055-2067, 2070-2095, 2097-2110, 2115-2121, 2150-2171, 2174-2180, 2197-2202, 2206-2228 and 1526-1560 of Seq ID No 178; 4-17, 35-48, 54-76, 78-107, 109-115, 118-127, 134-140, 145-156, 169-174, 217-226, 232-240, 256-262, 267-273, 316-328, 340-346, 353-360, 402-409, 416-439, 448-456, 506-531, 540-546, 570-578, 586-593, 595-600, 623-632, 662-667, 674-681, 689-705, 713-724, 730-740, 757-763, 773-778, 783-796, 829-835, 861-871, 888-899, 907-939, 941-955, 957-969, 986-1000, 1022-1028, 1036-1044, 1068-1084, 1095-1102, 1118-1124, 1140-1146, 1148-1154, 1168-1181, 1185-1190, 1197-1207, 1218-1226, 1250-1270, 1272-1281, 1284-1296, 1312-1319, 1351-1358, 1383-1409, 1422-1428, 1438-1447, 1449-1461, 1482-1489, 1504-1510, 1518-1527, 1529-1537, 1544-1551, 1569-1575, 1622-1628, 1631-1637, 1682-1689, 1711-1718, 1733-1740, 1772-1783, 1818-1834, 1859-1872, 1-64 and 128-495 of Seq ID No 179; 8-28, 32-37, 62-69, 119-125, 137-149, 159-164, 173-189, 200-205, 221-229, 240-245, 258-265, 268-276, 287-293, 296-302, 323-329 and 1-95 of Seq ID No 180; 9-18, 25-38, 49-63, 65-72, 74-81, 94-117, 131-137, 139-146, 149-158, 162-188, 191-207, 217-225, 237-252, 255-269, 281-293, 301-326, 332-342, 347-354, 363-370, 373-380, 391-400, 415-424, 441-447 and 75-107 of Seq ID No 181; 4-24, 64-71, 81-87, 96-116, 121-128, 130-139, 148-155, 166-173, 176-184, 203-215, 231-238, 243-248, 256-261, 280-286, 288-306, 314-329 and 67-148 of Seq ID No 182; 4-10, 19-37, 46-52, 62-81, 83-89, 115-120, 134-139, 141-151, 168-186, 197-205, 209-234, 241-252, 322-335, 339-345, 363-379, 385-393, 403-431, 434-442, 447-454, 459-465, 479-484, 487-496 and 404-420 of Seq ID No 183; 10-35, 46-66, 71-77, 84-93, 96-122, 138-148, 154-172, 182-213, 221-233, 245-263, 269-275, 295-301, 303-309, 311-320, 324-336, 340-348, 351-359, 375-381 and 111-198 of Seq ID No 184; 14-25, 30-42, 47-61, 67-75, 81-91, 98-106, 114-122, 124-135, 148-193, 209-227 and 198-213 of Seq ID No 185; 5-18, 45-50, 82-90, 97-114, 116-136, 153-161, 163-171, 212-219, 221-227, 240-249, 267-281, 311-317, 328-337, 375-381, 390-395, 430-436, 449-455, 484-495, 538-543, 548-554, 556-564, 580-586, 596-602 and 493-606 of Seq ID No 186; 9-25, 28-34, 37-44, 61-68, 75-81, 88-96, 98-111, 119-133, 138-150, 152-163, 168-182, 186-194, 200-205, 216-223, 236-245, 257-264, 279-287, 293-304, 311-318, 325-330, 340-346, 353-358, 365-379, 399-409, 444-453 and 303-391 of Seq ID No 187; 16-36, 55-61, 66-76, 78-102, 121-130, 134-146, 150-212, 221-239, 255-276, 289-322, 329-357 and 29-59 of Seq ID No 188; 8-27, 68-74, 77-99, 110-116, 124-141, 171-177, 202-217, 221-228, 259-265, 275-290, 293-303, 309-325, 335-343, 345-351, 365-379, 384-394, 406-414, 423-437, 452-465, 478-507, 525-534, 554-560, 611-624, 628-651, 669-682, 742-747, 767-778, 782-792, 804-812, 820-836, 79-231 and 359-451 of Seq ID No 189; 5-28, 39-45, 56-62, 67-74, 77-99, 110-117, 124-141, 168-176, 200-230, 237-244, 268-279, 287-299, 304-326, 329-335, 348-362, 370-376, 379-384, 390-406, 420-429, 466-471, 479-

489, 495-504, 529-541, 545-553, 561-577, 598-604, 622-630, 637-658, 672-680, 682-688, 690-696, 698-709, 712-719, 724-736, 738-746, 759-769, 780-786, 796-804, 813-818, 860-877, 895-904, 981-997, 1000-1014, 1021-1029, 1-162, 206-224, 254-350, 414-514 and 864-938 of Seq ID No 190; 4-11, 19-49, 56-66, 68-101, 109-116, 123-145, 156-165, 177-185, 204-221, 226-234, 242-248, 251-256, 259-265, 282-302, 307-330, 340-349, 355-374, 377-383, 392-400, 422-428, 434-442, 462-474 and 266-322 of Seq ID No 191; 14-43, 45-57, 64-74, 80-87, 106-127, 131-142, 145-161, 173-180, 182-188, 203-210, 213-219, 221-243, 245-254, 304-311, 314-320, 342-348, 354-365, 372-378, 394-399, 407-431, 436-448, 459-465, 470-477, 484-490, 504-509, 531-537, 590-596, 611-617, 642-647, 723-734, 740-751, 754-762, 764-774, 782-797, 807-812, 824-831, 838-845, 877-885, 892-898, 900-906, 924-935, 940-946, 982-996, 1006-1016, 1033-1043, 1051-1056, 1058-1066, 1094-1108, 1119-1126, 1129-1140, 1150-1157, 1167-1174, 1176-1185, 1188-1201, 1209-1216, 1220-1228, 1231-1237, 1243-1248, 1253-1285, 1288-1297, 1299-1307, 1316-1334, 1336-1343, 1350-1359, 1365-1381, 1390-1396, 1412-1420, 1427-1439, 1452-1459, 1477-1484, 1493-1512, 1554-1559, 1570-1578, 1603-1608, 1623-1630, 1654-1659, 1672-1680, 1689-1696, 1705-1711, 1721-1738, 1752-1757, 1773-1780, 1817-1829, 1844-1851, 1856-1863, 1883-1895, 1950-1958, 1974-1990, 172-354, 384-448, 464-644, 648-728 and 1357-1370 of Seq ID No 192; 8-27, 68-74, 77-99, 110-116, 124-141, 169-176, 201-216, 220-227, 258-264, 274-289, 292-302, 308-324, 334-342, 344-350, 364-372, 377-387, 399-407, 416-429, 445-458, 471-481, 483-500, 518-527, 547-553, 604-617, 621-644, 662-675, 767-778, 809-816, 15-307, 350-448 and 496-620 of Seq ID No 193; 4-17, 24-29, 53-59, 62-84, 109-126, 159-164, 189-204, 208-219, 244-249, 274-290, 292-302, 308-324, 334-342, 344-350, 378-389, 391-397, 401-409, 424-432, 447-460, 470-479, 490-504, 521-529, 538-544, 549-555, 570-577, 583-592, 602-608, 615-630, 635-647, 664-677, 692-698, 722-731, 733-751, 782-790, 793-799, 56-267, 337-426 and 495-601 of Seq ID No 194; 12-22, 49-59, 77-89, 111-121, 136-148, 177-186, 207-213, 217-225, 227-253, 259-274, 296-302, 328-333, 343-354, 374-383, 424-446, 448-457, 468-480, 488-502, 507-522, 544-550, 553-560, 564-572, 587-596, 604-614, 619-625, 629-635, 638-656, 662-676, 680-692, 697-713, 720-738, 779-786, 833-847, 861-869, 880-895, 897-902, 911-917, 946-951, 959-967, 984-990, 992-1004, 1021-1040, 1057-1067, 1073-1080 and 381-403 of Seq ID No 195; 4-10, 26-31, 46-56, 60-66, 70-79, 86-94, 96-102, 109-118, 132-152, 164-187, 193-206, 217-224 and 81-149 of Seq ID No 196; 4-21, 26-37, 48-60, 71-82, 109-117, 120-128, 130-136, 142-147, 181-187, 203-211, 216-223, 247-255, 257-284, 316-325, 373-379, 395-400, 423-435, 448-456, 479-489, 512-576, 596-625, 641-678, 680-688, 692-715 and 346-453 of Seq ID No 197; 10-16, 25-31, 34-56, 58-69, 71-89, 94-110, 133-176, 186-193, 208-225, 240-250, 259-266, 302-307, 335-341, 376-383, 410-416 and 316-407 of Seq ID No 198; 11-29, 42-56, 60-75, 82-88, 95-110, 116-126, 132-143, 145-160, 166-172, 184-216 and 123-164 of Seq ID No 199; 11-29, 54-63, 110-117, 139-152, 158-166, 172-180, 186-193, 215-236, 240-251, 302-323, 330-335, 340-347, 350-366, 374-381 and 252-299 of Seq ID No 200; 18-27, 35-42, 50-56, 67-74, 112-136, 141-153, 163-171, 176-189, 205-213, 225-234, 241-247, 253-258, 269-281, 288-298, 306-324, 326-334, 355-369, 380-387 and 289-320 of Seq ID No 201; 7-15, 19-41, 56-72, 91-112, 114-122, 139-147, 163-183, 196-209, 258-280, 326-338, 357-363, 391-403, 406-416 and 360-378 of Seq ID No 202; 11-18, 29-41, 43-49, 95-108, 142-194, 204-212, 216-242, 247-256, 264-273 and 136-149 of Seq ID No 203; 18-24, 33-40, 65-79, 89-102, 113-119, 130-137, 155-161, 173-179, 183-203, 205-219, 223-231, 245-261, 267-274, 296-306, 311-321, 330-341, 344-363, 369-381, 401-408, 415-427, 437-444, 453-464, 472-478, 484-508, 517-524, 526-532, 543-548 and 59-180 of Seq ID No 204; 5-13, 52-65, 67-73, 97-110, 112-119, 134-155 and 45-177 of Seq ID No 205; 6-28, 34-43, 57-67, 75-81, 111-128, 132-147, 155-163, 165-176, 184-194, 208-216, 218-229, 239-252, 271-278, 328-334, 363-376, 381-388, 426-473, 481-488, 492-498, 507-513, 536-546, 564-582, 590-601, 607-623, 148-269, 420-450 and 610-648 of Seq ID No 206; 4-12, 20-38, 69-75, 83-88, 123-128, 145-152, 154-161, 183-188, 200-213, 245-250, 266-272, 306-312, 332-339, 357-369, 383-389, 395-402, 437-453, 455-470, 497-503 and 1-112 of Seq ID No 207; 35-59, 74-86, 111-117, 122-137 and 70-154 of Seq ID No 208; 26-42, 54-61, 65-75, 101-107, 123-130, 137-144, 148-156, 164-172, 177-192, 213-221, 231-258 and 157-249 of Seq ID No 209; 29-38, 61-67, 77-87, 94-100, 105-111, 118-158 and 1-97 of Seq ID No 210; 7-21, 30-48, 51-58, 60-85, 94-123, 134-156, 160-167, 169-183, 186-191, 216-229, 237-251, 257-267, 272-282, 287-298 and 220-243 of Seq ID No 211; 6-29, 34-47, 56-65, 69-76, 83-90, 123-134, 143-151, 158-178, 197-203, 217-235, 243-263, 303-309, 320-333, 338-348, 367-373, 387-393, 407-414, 416-427, 441-457, 473-482, 487-499, 501-509, 514-520, 530-535, 577-583, 590-602, 605-612, 622-629, 641-670, 678-690, 37-71 and 238-307 of Seq ID No 212; 7-40, 121-132, 148-161, 196-202, 209-215, 221-235, 248-255, 271-280, 288-295, 330-339, 395-409, 414-420, 446-451, 475-487, 556-563, 568-575, 580-586, 588-595, 633-638, 643-648, 652-659, 672-685, 695-700, 710-716, 737-742, 749-754, 761-767, 775-781, 796-806, 823-835, 850-863, 884-890, 892-900, 902-915, 934-941 and 406-521 of Seq ID No 213; 9-18, 24-46, 51-58, 67-77, 85-108, 114-126, 129-137, 139-146, 152-165, 173-182, 188-195, 197-204, 217-250, 260-274, 296-313, 343-366, 368-384, 427-434, 437-446, 449-455, 478-484, 492-506, 522-527, 562-591, 599-606, 609-618, 625-631, 645-652 and 577-654 of Seq ID No 214; 13-20, 26-37, 41-53, 56-65, 81-100, 102-114, 118-127, 163-188, 196-202, 231-238, 245-252, 266-285, 293-298, 301-306 and 19-78 of Seq ID No 215; 10-23, 32-42, 54-66, 73-91, 106-113, 118-127, 139-152, 164-173, 198-207, 210-245, 284-300, 313-318, 330-337, 339-346, 354-361, 387-393, 404-426, 429-439, 441-453, 467-473, 479-485, 496-509, 536-544, 551-558, 560-566, 569-574, 578-588, 610-615, 627-635, 649-675, 679-690, 698-716, 722-734, 743-754, 769-780, 782-787 and 480-550 of Seq ID No 216; 6-39, 42-50, 60-68, 76-83, 114-129, 147-162, 170-189, 197-205, 217-231, 239-248, 299-305, 338-344, 352-357, 371-377, 380-451, 459-483, 491-499, 507-523, 537-559, 587-613, 625-681, 689-729, 737-781, 785-809, 817-865, 873-881, 889-939, 951-975, 983-1027, 1031-1055, 1063-1071, 1079-1099, 1103-1127, 1151-1185, 1197-1261, 1269-1309, 1317-1333, 1341-1349, 1357-1465, 1469-1513, 1517-1553, 1557-1629, 1637-1669, 1677-1701, 1709-1725, 1733-1795, 1823-1849, 1861-1925, 1933-1973, 1981-2025, 2029-2053, 2061-2109, 2117-2125, 2133-2183, 2195-2219, 2227-2271, 2275-2299, 2307-2315, 2323-2343, 2347-2371, 2395-2429, 2441-2529, 2537-2569, 2577-2601, 2609-2625, 2633-2695, 2699-2737, 2765-2791, 2803-2867, 2889-2913, 2921-2937, 2945-2969, 2977-2985, 2993-3009, 3023-3045, 3073-3099, 3111-3167, 3175-3215, 3223-3267, 3271-3295, 3303-3351, 3359-3367, 3375-3425, 3437-3461, 3469-3513, 3517-3541, 3549-3557, 3565-3585, 3589-3613, 3637-3671, 3683-3747, 3755-3795, 3803-3819, 3827-3835, 3843-3951, 3955-3999, 4003-4039, 4043-4115, 4123-4143, 4147-4171, 4195-4229, 4241-4305, 4313-4353, 4361-4377, 4385-4393, 4401-4509, 4513-4557, 4561-4597, 4601-4718, 4749-4768, 74-171, 452-559 and 2951-3061 of Seq ID No 217; 16-22, 30-51, 70-111, 117-130, 137-150, 171-178, 180-188, 191-196 and 148-181 of Seq ID No 218; 6-19, 21-46, 50-56, 80-86, 118-126, 167-186, 189-205, 211-242, 244-267, 273-286, 290-297, 307-316, 320-341 and 34-60 of Seq ID No 219; 5-26, 33-43, 48-54, 58-63, 78-83, 113-120, 122-128, 143-152, 157-175, 185-192, 211-225, 227-234, 244-256, 270-281, 284-290, 304-310, 330-337, 348-355, 362-379, 384-394, 429-445, 450-474, 483-490, 511-520, 537-546, 548-554, 561-586, 590-604, 613-629, 149-186, 285-431 and 573-659 of Seq ID No 220; 5-26, 49-59, 61-67, 83-91, 102-111, 145-157, 185-192, 267-272, 279-286, 292-298, 306-312, 134-220, 235-251 and 254-280 of Seq ID No 221; 5-19, 72-79, 83-92, 119-124, 140-145, 160-165, 167-182, 224-232, 240-252, 259-270, 301-310, 313-322, 332-343, 347-367, 384-398, 416-429, 431-446, 454-461 and 1-169 of Seq ID No 222; 8-17, 26-31, 56-62, 75-83, 93-103, 125-131, 135-141, 150-194, 205-217, 233-258, 262-268, 281-286 and 127-168 of Seq ID No 223; 6-12, 69-75, 108-115, 139-159, 176-182, 194-214 and 46-161 of Seq ID No 224; 6-13, 18-27, 39-48, 51-59, 66-73, 79-85, 95-101, 109-116, 118-124, 144-164, 166-177, 183-193, 197-204, 215-223, 227-236, 242-249, 252-259, 261-270, 289-301, 318-325 and 12-58 of Seq ID No 225; 4-10, 26-32, 48-60, 97-105, 117-132, 138-163, 169-185, 192-214, 219-231, 249-261, 264-270, 292-308, 343-356, 385-392, 398-404, 408-417, 435-441 and 24-50 of Seq ID No 226; 10-40, 42-48, 51-61, 119-126 and 1-118 of Seq ID No 227; 5-17, 40-58, 71-83, 103-111, 123-140, 167-177, 188-204 and 116-128 of Seq ID No 228; 4-9, 11-50, 57-70, 112-123, 127-138 and 64-107 of Seq ID No 229; 9-39, 51-67 and 1-101 of Seq ID No 230; 5-14, 17-25, 28-46, 52-59, 85-93, 99-104, 111-120, 122-131, 140-148, 158-179, 187-197, 204-225, 271-283, 285-293 and 139-155 of Seq ID No 231; 42-70, 73-90, 92-108, 112-127, 152-164, 166-172, 181-199, 201-210, 219-228, 247-274, 295-302, 322-334, 336-346, 353-358, 396-414, 419-425, 432-438, 462-471, 518-523, 531-536, 561-567, 576-589, 594-612, 620-631, 665-671, 697-710, 718-731, 736-756, 765-771, 784-801 and 626-653 of Seq ID No 232; 8-28, 41-51, 53-62, 68-74, 79-85, 94-100, 102-108, 114-120, 130-154, 156-162, 175-180, 198-204, 206-213, 281-294, 308-318, 321-339, 362-368, 381-386, 393-399, 407-415 and 2-13 of Seq ID No 233; 4-39, 48-65, 93-98, 106-112, 116-129 and 10-36 of Seq ID No 234; 25-32, 35-50, 66-71, 75-86, 90-96, 123-136, 141-151, 160-179, 190-196, 209-215, 222-228, 235-242, 257-263, 270-280 and 209-247 of Seq ID No 235; 5-29, 31-38, 50-57, 62-75, 83-110, 115-132, 168-195, 197-206, 216-242, 249-258, 262-269, 333-340, 342-350, 363-368, 376-392, 400-406, 410-421, 423-430, 436-442, 448-454, 460-466, 471-476, 491-496, 511-516, 531-536, 551-556, 571-576, 585-591, 599-605, 27-70, 219-293, 441-504 and 512-584 of Seq ID No 236; 4-12, 14-34, 47-75, 83-104, 107-115, 133-140, 148-185, 187-196, 207-212, 224-256, 258-265, 281-287, 289-296, 298-308, 325-333, 345-355, 365-371, 382-395, 424-435, 441-457, 465-472, 483-491, 493-505, 528-534, 536-546, 552-558, 575-584, 589-600, 616-623 and 576-591 of Seq ID No 237; 4-76, 78-89, 91-126, 142-148, 151-191, 195-208, 211-223, 226-240, 256-277, 279-285, 290-314, 317-323, 358-377, 381-387, 391-396, 398-411, 415-434, 436-446, 454-484, 494-512, 516-523, 538-552, 559-566, 571-577, 579-596, 599-615, 620-627, 635-644, 694-707, 720-734, 737-759, 761-771 and 313-329 of Seq ID No 238; 7-38, 44-49, 79-89, 99-108, 117-123, 125-132, 137-146, 178-187, 207-237, 245-255, 322-337, 365-387, 398-408, 445-462, 603-608, 623-628, 644-650, 657-671, 673-679 and 111-566 of Seq ID No 239; 6-20, 22-35, 39-45, 58-64, 77-117, 137-144, 158-163, 205-210, 218-224, 229-236, 239-251, 263-277, 299-307, 323-334, 353-384, 388-396, 399-438, 443-448, 458-463, 467-478, 481-495, 503-509, 511-526, 559-576, 595-600, 612-645, 711-721, 723-738, 744-758, 778-807 and 686-720 of Seq ID No 240; 10-33, 35-41, 72-84, 129-138, 158-163, 203-226, 243-252, 258-264, 279-302, 322-329, 381-386, 401-406, 414-435 and 184-385 of Seq ID No 241; 4-9, 19-24, 41-47, 75-85, 105-110, 113-146 and 45-62 of Seq ID No 242; 4-25, 52-67, 117-124, 131-146, 173-180, 182-191, 195-206, 215-221, 229-236, 245-252, 258-279, 286-291, 293-302, 314-320, 327-336, 341-353, 355-361, 383-389 and 1-285 of Seq ID No 243; 14-32, 38-50, 73-84, 93-105, 109-114 and 40-70 of Seq ID No 244; 5-26 and 22-34 of Seq ID No 245; 23-28 and 13-39 of Seq ID No 246; 8-14 and 21-34 of Seq ID No 247; 4-13, 20-29, 44-50, 59-74 and 41-69 of Seq ID No 248; 4-9, 19-42, 48-59, 71-83 and 57-91 of Seq ID No 249; 4-14 and 10-28 of Seq ID No 250; 22-28, 32-42, 63-71, 81-111, 149-156, 158-167, 172-180, 182-203, 219-229 and 27-49 of Seq ID No 251; 17-27 and 23-32 of Seq ID No 252; 18-24 and 28-38 of Seq ID No 253; 9-15 and 13-27 of Seq ID No 254; 13-22 and 18-29 of Seq ID No 255; 17-26 and 2-11 of Seq ID No 256; 4-33 and 16-32 of Seq ID No 257; 4-10, 37-43, 54-84, 92-127 and 15-62 of Seq ID No 258; 4-14, 20-32, 35-60, 69-75, 79-99, 101-109, 116-140 and 124-136 of Seq ID No 259; 2-13 of Seq ID No 260; 4-13, 28-42 and 42-57 of Seq ID No 261; 4-14, 27-44 and 14-35 of Seq ID No 262; 4-12 and 1-27 of Seq ID No 263; 4-18, 39-45, 47-74 and 35-66 of Seq ID No 264; 8-20, 43-77 and 17-36 of Seq ID No 265; 4-30, 35-45, 51-57 and 35-49 of Seq ID No 266; 4-24, 49-57 and 15-34 of Seq ID No 267; 4-22 and 8-27 of Seq ID No 268; 13-25, 32-59, 66-80 and 21-55 of Seq ID No 269; 4-10, 24-33, 35-42, 54-65, 72-82, 98-108 and 15-30 of Seq ID No 270; 8-19 and 17-47 of Seq ID No 271; 12-18, 40-46 and 31-52 of Seq ID No 272; 4-20, 35-78, 83-102, 109-122 and 74-86 of Seq ID No 273; 7-17, 21-41, 46-63 and 2-20 of Seq ID No 274; 30-37 and 2-33 of Seq ID No 275; 4-13, 17-25 and 1-15 of Seq ID No 276; 17-31, 44-51 and 20-51 of Seq ID No 277; 20-30 and 5-23 of Seq ID No 278; 13-33, 48-71 and 92-110 of Seq ID No 279; 4-9, 50-69, 76-88, 96-106, 113-118 and 12-34 of Seq ID No 280; 4-24 and 6-26 of Seq ID No 281; 7-26 and 14-30 of Seq ID No 282; 9-39, 46-68, 75-82, 84-103 and 26-44 of Seq ID No 283; 4-30, 33-107 and 58-84 of Seq ID No 284; 4-12 and 9-51 of Seq ID No 285; 12-18, 29-37 and 6-37 of Seq ID No 286; 4-21, 33-52, 64-71 and 16-37 of Seq ID No 287; 9-19 and 2-30 of Seq ID No 288; 20-37 of Seq ID No 245; 8-27 of Seq ID No 246; 10-27 of Seq ID No 247; 42-59 and 52-69 of Seq ID No 248; 63-80 and 74-91 of Seq ID No 249; 11-28 of Seq ID No 250; 28-49 of Seq ID No 251; 15-32 of Seq ID No 252; 4-20 of Seq ID No 253; 10-27 of Seq ID No 254; 17-34 of Seq ID No 255; 1-18 of Seq ID No 256; 16-33 of Seq ID No 257; 16-36, 30-49 and 43-62 of Seq ID No 258; 122-139 of Seq ID No 259; 1-18 of Seq ID No 260; 41-58 of Seq ID No 261; 15-35 of Seq ID No 262; 2-27 of Seq ID No 263; 18-36 of Seq ID No 265; 34-51 of Seq ID No 266; 9-27 of Seq ID No 268; 22-47 of Seq ID No 269; 18-36 and 29-47 of Seq ID No 271; 32-52 of Seq ID No 272; 72-89 of Seq ID No 273; 3-20 of Seq ID No 274; 3-21 and 15-33 of Seq ID No 275; 1-18 of Seq ID No 276; 6-23 of Seq ID No 278; 93-110 of Seq ID No 279; 13-34 of Seq ID No 280; 7-26 and 9-26 of Seq ID No 281; 16-33 of Seq ID No 282; 27-44 of Seq ID No 283; 67-84 of Seq ID No 284; 10-33 and 26-50 of Seq ID No 285; 7-25 and 19-37 of Seq ID No 286; 17-37 of Seq ID No 287; 3-20 and 13-30 of Seq ID No 288; 62-80 and 75-93 of Seq ID No 145; 92-108 of Seq ID No 147; 332-349, 177-200 and 1755-1777 of Seq ID No 148; 109-133, 149-174, 260-285 and 460-485 of Seq ID No 149; 26-47 and 42-64 of Seq ID No 150; 22-41, 35-54, 115-130, 306-325, 401-420 and 454-478 of Seq ID No 151; 22-45 of Seq ID No 155; 156-174, 924-940, 1485-1496, 1447-1462 and 1483-1498 of Seq ID No 160; 457-475 of Seq ID No 161; 302-325 of Seq ID No 163; 288-305 of Seq ID No 164; 244-266 and 260-282 of Seq ID No 165; 204-225 and 220-241 of Seq ID No 166; 324-345, 340-361, 356-377, 372-393 and 388-408 of Seq ID No 167; 39-64 of Seq ID No 168; 54-76 and 70-92 of Seq ID No 169; 1227-1247, 1539-1559, 1554-1574, 1569-1589, 1584-1604, 1242-1262, 1272-1292, 1287-1308, 1456-1477, 1472-1494, 1488-1510 and 1505-1526 of Seq ID No 170; 351-368 of Seq ID No 172; 179-200, 195-216, 211-232, 227-248 and 243-263 of Seq ID No 173; 13-37 of Seq ID No 174; 208-224 of Seq ID No 175; 42-64, 59-81, 304-328, 323-348, 465-489, 968-992, 1399-1418, 1412-1431 and 2092-2111 of Seq ID No 177; 1528-1547 and 1541-1560 of Seq ID No 178; 184-200, 367-388, 382-403, 409-429, 425-444 and 438-457 of Seq ID No 179; 27-50 and 45-67 of Seq ID No 180; 114-131 and 405-419 of Seq Id No 183; 113-134, 129-150, 145-166, 161-182 and 177-198 of Seq ID No 184; 495-515 of Seq ID No 186; 346-358 of Seq ID No 187; 208-224 of Seq ID No 190; 178-194, 202-223, 217-238, 288-308 and 1355-1372 of Seq ID No 192; 57-78 of Seq ID No 194; 347-369, 364-386, 381-403, 398-420, 415-437 and 432-452 of Seq ID No 197; 347-372 of Seq ID No 198; 147-163 of Seq ID No 199; 263-288 of Seq ID No 200; 361-377 of Seq ID No 202; 82-104, 99-121, 116-138, 133-155 and 150-171 of Seq ID No 204; 110-130 and 125-145 of Seq ID No 205; 613-631, 626-644 and 196-213 of Seq ID No 206; 78-100, 95-117, 112-134 and 129-151 of Seq ID No 208; 158-180, 175-197, 192-214, 209-231 and 226-248 of Seq ID No 209; 30-50, 45-65 and 60-79 of Seq ID No 210; 431-455 and 450-474 of Seq ID No 213; 579-601, 596-618, 613-635 and 630-653 of Seq ID No 214; 920-927, 98-119, 114-135, 130-151, 146-167 and 162-182 of Seq ID No 217; 36-59 of Seq ID No 219; 194-216 and 381-404 of Seq ID No 220; 236-251 and 255-279 of Seq ID No 221; 80-100 and 141-164 of Seq ID No 222; 128-154 of Seq ID No 223; 82-100, 95-116 and 111-134 of Seq ID No 224; 55-76, 71-92 and 87-110 of Seq ID No 227; 91-106 of Seq ID No 229; 74-96 of Seq ID No 230; 140-157 of Seq ID No 231; 4-13 of Seq ID No 233; 41-65 and 499-523 of Seq ID No 236; 122-146, 191-215, 288-313, 445-469 and 511-535 of Seq ID No 239; 347-368 of Seq ID No 241; 46-61 of Seq ID No 242; 15-37, 32-57, 101-121, 115-135, 138-158, 152-172, 220-242 and 236-258 of Seq ID No 243.

The present invention also provides a process for producing a S. pneumoniae hyperimmune serum reactive antigen or a fragment thereof according to the present invention comprising expressing one or more of the nucleic acid molecules according to the present invention in a suitable expression system.

Moreover, the present invention provides a process for producing a cell, which expresses a S pneumoniae hyperimmune serum reactive antigen or a fragment thereof according to the present invention comprising transforming or transfecting a suitable host cell with the vector according to the present invention.

According to the present invention a pharmaceutical composition, especially a vaccine, comprising a hyperimmune serum-reactive antigen or a fragment thereof as defined in the present invention or a nucleic acid molecule as defined in the present invention is provided.

In a preferred embodiment the pharmaceutical composition further comprises an immunostimulatory substance, preferably selected from the group comprising polycationic polymers, especially polycationic peptides, immunostimulatory deoxynucleotides (ODNs), peptides containing at least two LysLeuLys motifs, especially KLKLLLLLKLK, neuroactive compounds, especially human growth hormone, alumn, Freund's complete or incomplete adjuvants or combinations thereof.

In a more preferred embodiment the immunostimulatory substance is a combination of either a polycationic polymer and immunostimulatory deoxynucleotides or of a peptide containing at least two LysLeuLys motifs and immunostimulatory deoxynucleotides.

In a still more preferred embodiment the polycationic polymer is a polycationic peptide, especially polyarginine.

According to the present invention the use of a nucleic acid molecule according to the present invention or a hyperimmune serum-reactive antigen or fragment thereof according to the present invention for the manufacture of a pharmaceutical preparation, especially for the manufacture of a vaccine against S. pneumoniae infection, is provided.

Also an antibody, or at least an effective part thereof, which binds at least to a selective part of the hyperimmune serum-reactive antigen or a fragment thereof according to the present invention, is provided herewith.

In a preferred embodiment the antibody is a monoclonal antibody.

In another preferred embodiment the effective part of the antibody comprises Fab fragments.

In a further preferred embodiment the antibody is a chimeric antibody.

In a still preferred embodiment the antibody is a humanized antibody.

The present invention also provides a hybridoma cell line, which produces an antibody according to the present invention.

Moreover, the present invention provides a method for producing an antibody according to the present invention, characterized by the following steps:
  initiating an immune response in a non-human animal by administrating an hyperimmune serum-reactive antigen or a fragment thereof, as defined in the invention, to said animal,
  removing an antibody containing body fluid from said animal, and
  producing the antibody by subjecting said antibody containing body fluid to further purification steps.

Accordingly, the present invention also provides a method for producing an antibody according to the present invention, characterized by the following steps:
  initiating an immune response in a non-human animal by administrating an hyperimmune serum-reactive antigen or a fragment thereof, as defined in the present invention, to said animal,
  removing the spleen or spleen cells from said animal,
  producing hybridoma cells of said spleen or spleen cells,
  selecting and cloning hybridoma cells specific for said hyperimmune serum-reactive antigens or a fragment thereof,
  producing the antibody by cultivation of said cloned hybridoma cells and optionally further purification steps.

The antibodies provided or produced according to the above methods may be used for the preparation of a medicament for treating or preventing S. pneumoniae infections.

According to another aspect the present invention provides an antagonist, which binds to a hyperimmune serum-reactive antigen or a fragment thereof according to the present invention.

Such an antagonist capable of binding to a hyperimmune serum-reactive antigen or fragment thereof according to the present invention may be identified by a method comprising the following steps:

a) contacting an isolated or immobilized hyperimmune serum-reactive antigen or a fragment thereof according to the present invention with a candidate antagonist under conditions to permit binding of said candidate antagonist to said hyperimmune serum-reactive antigen or fragment, in the presence of a component capable of providing a detectable signal in response to the binding of the candidate antagonist to said hyperimmune serum reactive antigen or fragment thereof; and b) detecting the presence or absence of a signal generated in response to the binding of the antagonist to the hyperimmune serum reactive antigen or the fragment thereof.

An antagonist capable of reducing or inhibiting the interaction activity of a hyperimmune serum-reactive antigen or a fragment thereof according to the present invention to its interaction partner may be identified by a method comprising the following steps:

a) providing a hyperimmune serum reactive antigen or a hyperimmune fragment thereof according to the present invention, b) providing an interaction partner to said hyperimmune serum reactive antigen or a fragment thereof, especially an antibody according to the present invention, c) allowing interaction of said hyperimmune serum reactive antigen or fragment thereof to said interaction partner to form an interaction complex, d) providing a candidate antagonist, e) allowing a competition reaction to occur between the candidate antagonist and the interaction complex, f) determining whether the candidate antagonist inhibits or reduces the interaction activities of the hyperimmune serum reactive antigen or the fragment thereof with the interaction partner.

The hyperimmune serum reactive antigens or fragments thereof according to the present invention may be used for the isolation and/or purification and/or identification of an interaction partner of said hyperimmune serum reactive antigen or fragment thereof.

The present invention also provides a process for in vitro diagnosing a disease related to expression of a hyperimmune serum-reactive antigen or a fragment thereof according to the present invention comprising determining the presence of a nucleic acid sequence encoding said hyperimmune serum reactive antigen or fragment thereof according to the present invention or the presence of the hyperimmune serum reactive antigen or fragment thereof according to the present invention.

The present invention also provides a process for in vitro diagnosis of a bacterial infection, especially a *S. pneumoniae* infection, comprising analyzing for the presence of a nucleic acid sequence encoding said hyperimmune serum reactive antigen or fragment thereof according to the present invention or the presence of the hyperimmune serum reactive antigen or fragment thereof according to the present invention.

Moreover, the present invention provides the use of a hyperimmune serum reactive antigen or fragment thereof according to the present invention for the generation of a peptide binding to said hyperimmune serum reactive antigen or fragment thereof, wherein the peptide is an anticaline.

The present invention also provides the use of a hyperimmune serum-reactive antigen or fragment thereof according to the present invention for the manufacture of a functional nucleic acid, wherein the functional nucleic acid is selected from the group comprising aptamers and spiegelmers.

The nucleic acid molecule according to the present invention may also be used for the manufacture of a functional ribonucleic acid, wherein the functional ribonucleic acid is selected from the group comprising ribozymes, antisense nucleic acids and siRNA.

The present invention advantageously provides an efficient, relevant and comprehensive set of isolated nucleic acid molecules and their encoded hyperimmune serum reactive antigens or fragments thereof identified from *S. pneumoniae* using an antibody preparation from multiple human plasma pools and surface expression libraries derived from the genome of *S. pneumoniae*. Thus, the present invention fulfils a widely felt demand for *S. pneumoniae* antigens, vaccines, diagnostics and products useful in procedures for preparing antibodies and for identifying compounds effective against *S. pneumoniae* infection.

An effective vaccine should be composed of proteins or polypeptides, which are expressed by all strains and are able to induce high affinity, abundant antibodies against cell surface components of *S. pneumoniae*. The antibodies should be IgG1 and/or IgG3 for opsonization, and any IgG subtype and IgA for neutralisation of adherence and toxin action. A chemically defined vaccine must be definitely superior compared to a whole cell vaccine (attenuated or killed), since components of *S. pneumoniae*, which cross-react with human tissues or inhibit opsonization can be eliminated, and the individual proteins inducing protective antibodies and/or a protective immune response can be selected.

The approach, which has been employed for the present invention, is based on the interaction of pneumococcal proteins or peptides with the antibodies present in human sera. The antibodies produced against *S. pneumoniae* by the human immune system and present in human sera are indicative of the in vivo expression of the antigenic proteins and their immunogenicity. In addition, the antigenic proteins as identified by the bacterial surface display expression libraries using pools of pre-selected sera, are processed in a second and third round of screening by individual selected or generated sera. Thus the present invention supplies an efficient, relevant, comprehensive set of pneumoococcal antigens as a pharmaceutical composition, especially a vaccine preventing infection by *S. pneumoniae*.

In the antigen identification program for identifying a comprehensive set of antigens according to the present invention, at least two different bacterial surface expression libraries are screened with several serum pools or plasma fractions or other pooled antibody containing body fluids (antibody pools). The antibody pools are derived from a serum collection, which has been tested against antigenic compounds of *S. pneumoniae*, such as whole cell extracts and culture supernatant proteins. Preferably, two distinct serum collections are used: 1. With very stable antibody repertoire: normal adults, clinically healthy people, who are non-carriers and overcame previous encounters or currently carriers of *S. pneumoniae* without acute disease and symptoms, 2. With antibodies induced acutely by the presence of the pathogenic organism: patients with acute disease with different manifestations (e.g. *S. pneumoniae* pharyngitis, pneumonia, bacteraemia, peritonitis, meningitis and sepsis). Sera have to react with multiple *Pneumococcus*-specific antigens in order to be considered hyperimmune and therefore relevant in the screening method applied for the present invention.

The expression libraries as used in the present invention should allow expression of all potential antigens, e.g. derived from all secreted and surface proteins of *S. pneumoniae*. Bacterial surface display libraries will be represented by a recombinant library of a bacterial host displaying a (total) set of expressed peptide sequences of *S. pneumoniae* on two selected outer membrane proteins (LamB and FhuA) at the bacterial host membrane {Georgiou, G., 1997}; {Etz, H. et al., 2001}. One of the advantages of using recombinant expression libraries is that the identified hyperimmune serum-reactive antigens may be instantly produced by expression of the coding sequences of the screened and selected clones expressing the hyperimmune serum-reactive antigens without further recombinant DNA technology or cloning steps necessary.

The comprehensive set of antigens identified by the described program according to the present invention is analysed further by one or more additional rounds of screening. Therefore individual antibody preparations or antibodies generated against selected peptides, which were identified as immunogenic are used. According to a preferred embodiment the individual antibody preparations for the second round of screening are derived from patients who have suffered from an acute infection with S. pneumoniae, especially from patients who show an antibody titer above a certain minimum level, for example an antibody titer being higher than 80 percentile, preferably higher than 90 percentile, especially higher than 95 percentile of the human (patient or healthy individual) sera tested. Using such high titer individual antibody preparations in the second screening round allows a very selective identification of the hyperimmune serum-reactive antigens and fragments thereof from S. pneumoniae.

Following the comprehensive screening procedure, the selected antigenic proteins, expressed as recombinant proteins or in vitro translated products, in case it can not be expressed in prokaryotic expression systems, or the identified antigenic peptides (produced synthetically) are tested in a second screening by a series of ELISA and Western blotting assays for the assessment of their immunogenicity with a large human serum collection (minimum ~150 healthy and patients sera).

It is important that the individual antibody preparations (which may also be the selected serum) allow a selective identification of the most promising candidates of all the hyperimmune serum-reactive antigens from all the promising candidates from the first round. Therefore, preferably at least 10 individual antibody preparations (i.e. antibody preparations (e.g. sera) from at least 10 different individuals having suffered from an infection to the chosen pathogen) should be used in identifying these antigens in the second screening round. Of course, it is possible to use also less than 10 individual preparations, however, selectivity of the step may not be optimal with a low number of individual antibody preparations. On the other hand, if a given hyperimmune serum-reactive antigen (or an antigenic fragment thereof) is recognized by at least 10 individual antibody preparations, preferably at least 30, especially at least 50 individual antibody preparations, identification of the hyperimmune serum-reactive antigen is also selective enough for a proper identification. Hyperimmune serum-reactivity may of course be tested with as many individual preparations as possible (e.g. with more than 100 or even with more than 1,000).

Therefore, the relevant portion of the hyperimmune serum-reactive antibody preparations according to the method of the present invention should preferably be at least 10, more preferred at least 30, especially at least 50 individual antibody preparations. Alternatively (or in combination) hyperimmune serum-reactive antigens may preferably be also identified with at least 20%, preferably at least 30%, especially at least 40% of all individual antibody preparations used in the second screening round.

According to a preferred embodiment of the present invention, the sera from which the individual antibody preparations for the second round of screening are prepared (or which are used as antibody preparations), are selected by their titer against S. pneumoniae (e.g. against a preparation of this pathogen, such as a lysate, cell wall components and recombinant proteins). Preferably, some are selected with a total IgA titer above 2,000 U, especially above 4,000 U, and/or an IgG titer above 5,000 U, especially above 12,000 U (U=units, calculated from the $OD_{405nm}$ reading at a given dilution) when the whole organism (total lysate or whole cells) is used as antigen in the ELISA.

The antibodies produced against streptococci by the human immune system and present in human sera are indicative of the in vivo expression of the antigenic proteins and their immunogenicity. The recognition of linear epitopes recognized by serum antibodies can be based on sequences as short as 4-5 amino acids. Of course it does not necessarily mean that these short peptides are capable of inducing the given antibody in vivo. For that reason the defined epitopes, polypeptides and proteins are further to be tested in animals (mainly in mice) for their capacity to induce antibodies against the selected proteins in vivo.

The preferred antigens are located on the cell surface or are secreted, and are therefore accessible extracellularly. Antibodies against cell wall proteins are expected to serve multiple purposes: to inhibit adhesion, to interfere with nutrient acquisition, to inhibit immune evasion and to promote phagocytosis {Hornef, M. et al., 2002}. Antibodies against secreted proteins are beneficial in neutralisation of their function as toxin or virulence component. It is also known that bacteria communicate with each other through secreted proteins. Neutralizing antibodies against these proteins will interrupt growth-promoting cross-talk between or within streptococcal species. Bioinformatic analyses (signal sequences, cell wall localisation signals, transmembrane domains) proved to be very useful in assessing cell surface localisation or secretion. The experimental approach includes the isolation of antibodies with the corresponding epitopes and proteins from human serum, and the generation of immune sera in mice against (poly)peptides selected by the bacterial surface display screens. These sera are then used in a third round of screening as reagents in the following assays: cell surface staining of S. pneumoniae grown under different conditions (FACS or microscopy), determination of neutralizing capacity (toxin, adherence), and promotion of opsonization and phagocytosis (in vitro phagocytosis assay).

For that purpose, bacterial E. coli clones are directly injected into mice and immune sera are taken and tested in the relevant in vitro assay for functional opsonic or neutralizing antibodies. Alternatively, specific antibodies may be purified from human or mouse sera using peptides or proteins as substrate.

Host defence against S. pneumoniae relies mainly on opsonophagocytic killing mechanism. Inducing high affinity antibodies of the opsonic and neutralizing type by vaccination helps the innate immune system to eliminate bacteria and toxins. This makes the method according to the present invention an optimal tool for the identification of pneumococcal antigenic proteins.

The skin and mucous membranes are formidable barriers against invasion by streptococci. However, once the skin or the mucous membranes are breached the first line of non-adaptive cellular defence begins its co-ordinate action through complement and phagocytes, especially the polymorphonuclear leukocytes (PMNs). These cells can be regarded as the cornerstones in eliminating invading bacteria. As Streptococcus pneumoniae is a primarily extracellular pathogen, the major anti-streptococcal adaptive response comes from the humoral arm of the immune system, and is mediated through three major mechanisms: promotion of opsonization, toxin neutralisation, and inhibition of adherence. It is believed that opsonization is especially important, because of its requirement for an effective phagocytosis. For efficient opsonization the microbial surface has to be coated with antibodies and complement factors for recognition by PMNs through receptors to the Fc fragment of the IgG molecule or to activated C3b. After opsonization, streptococci are phagocytosed and killed. Antibodies bound to specific antigens on the cell surface of bacteria serve as ligands for the attachment to PMNs and to promote phagocytosis. The very same antibodies bound to the adhesins and other cell surface proteins are expected to neutralize adhesion and prevent colonization. The selection of antigens as provided by the present invention is thus well suited to identify those that will lead to protection against infection in an animal model or in humans.

According to the antigen identification method used herein, the present invention can surprisingly provide a set of comprehensive novel nucleic acids and novel hyperimmune serum reactive antigens and fragments thereof of *S. pneumoniae*, among other things, as described below. According to one aspect, the invention particularly relates to the nucleotide sequences encoding hyperimmune serum reactive antigens which sequences are set forth in the Sequence listing Seq ID No: 1-144, 289-303 and the corresponding encoded amino acid sequences representing hyperimmune serum reactive antigens are set forth in the Sequence Listing Seq ID No 145-288 and 304-318.

In a preferred embodiment of the present invention, a nucleic acid molecule is provided which exhibits 70% identity over their entire length to a nucleotide sequence set forth with Seq ID No 1, 101-144. Most highly preferred are nucleic acids that comprise a region that is at least 80% or at least 85% identical over their entire length to a nucleic acid molecule set forth with Seq ID No 1, 101-144. In this regard, nucleic acid molecules at least 90%, 91%, 92%, 93%, 94%, 95%, or 96% identical over their entire length to the same are particularly preferred. Furthermore, those with at least 97% are highly preferred, those with at least 98% and at least 99% are particularly highly preferred, with at least 99% or 99.5% being the more preferred, with 100% identity being especially preferred. Moreover, preferred embodiments in this respect are nucleic acids which encode hyperimmune serum reactive antigens or fragments thereof (polypeptides) which retain substantially the same biological function or activity as the mature polypeptide encoded by said nucleic acids set forth in the Seq ID No 1, 101-144.

Identity, as known in the art and used herein, is the relationship between two or more polypeptide sequences or two or more polynucleotide sequences, as determined by comparing the sequences. In the art, identity also means the degree of sequence relatedness between polypeptide or polynucleotide sequences, as the case may be, as determined by the match between strings of such sequences. Identity can be readily calculated. While there exist a number of methods to measure identity between two polynucleotide or two polypeptide sequences, the term is well known to skilled artisans (e.g. Sequence Analysis in Molecular Biology, von Heinje, G., Academic Press, 1987). Preferred methods to determine identity are designed to give the largest match between the sequences tested. Methods to determine identity are codified in computer programs. Preferred computer program methods to determine identity between two sequences include, but are not limited to, GCG program package {Devereux, J. et al., 1984}, BLASTP, BLASTN, and FASTA {Altschul, S. et al., 1990}.

According to another aspect of the invention, nucleic acid molecules are provided which exhibit at least 96% identity to the nucleic acid sequence set forth with Seq ID No 2-6, 8, 10-16, 18-23, 25-31, 34, 36, 38-42, 44, 47-48, 51, 53, 55-62, 64, 67, 71-76, 78-79, 81-94, 96-100.

According to a further aspect of the present invention, nucleic acid molecules are provided which are identical to the nucleic acid sequences set forth with Seq ID No 9, 17, 24, 32, 37, 43, 52, 54, 65-66, 70, 80.

The nucleic acid molecules according to the present invention can as a second alternative also be a nucleic acid molecule which is at least essentially complementary to the nucleic acid described as the first alternative above. As used herein complementary means that a nucleic acid strand is base pairing via Watson-Crick base pairing with a second nucleic acid strand. Essentially complementary as used herein means that the base pairing is not occurring for all of the bases of the respective strands but leaves a certain number or percentage of the bases unpaired or wrongly paired. The percentage of correctly pairing bases is preferably at least 70%, more preferably 80%, even more preferably 90% and most preferably any percentage higher than 90%. It is to be noted that a percentage of 70% matching bases is considered as homology and the hybridization having this extent of matching base pairs is considered as stringent. Hybridization conditions for this kind of stringent hybridization may be taken from Current Protocols in Molecular Biology (John Wiley and Sons, Inc., 1987). More particularly, the hybridization conditions can be as follows:

Hybridization performed e.g. in 5×SSPE, 5×Denhardt's reagent, 0.1% SDS, 100 g/mL sheared DNA at 68° C.
Moderate stringency wash in 0.2×SSC, 0.1% SDS at 42° C.
High stringency wash in 0.1×SSC, 0.1% SDS at 68° C.

Genomic DNA with a GC content of 50% has an approximate $T_M$ of 96° C. For 1% mismatch, the $T_M$ is reduced by approximately 1° C.

In addition, any of the further hybridization conditions described herein are in principle applicable as well.

Of course, all nucleic acid sequence molecules which encode the same polypeptide molecule as those identified by the present invention are encompassed by any disclosure of a given coding sequence, since the degeneracy of the genetic code is directly applicable to unambiguously determine all possible nucleic acid molecules which encode a given polypeptide molecule, even if the number of such degenerated nucleic acid molecules may be high. This is also applicable for fragments of a given polypeptide, as long as the fragments encode a polypeptide being suitable to be used in a vaccination connection, e.g. as an active or passive vaccine.

The nucleic acid molecule according to the present invention can as a third alternative also be a nucleic acid which comprises a stretch of at least 15 bases of the nucleic acid molecule according to the first and second alternative of the nucleic acid molecules according to the present invention as outlined above. Preferably, the bases form a contiguous stretch of bases. However, it is also within the scope of the present invention that the stretch consists of two or more moieties, which are separated by a number of bases.

The present nucleic acids may preferably consist of at least 20, even more preferred at least 30, especially at least 50 contiguous bases from the sequences disclosed herein. The suitable length may easily be optimized due to the planned area of use (e.g. as (PCR) primers, probes, capture molecules (e.g. on a (DNA) chip), etc.). Preferred nucleic acid molecules contain at least a contiguous 15 base portion of one or more of the predicted immunogenic amino acid sequences listed in tables 1 and 2, especially the sequences of table 2 with scores of more than 10, preferably more than 20, especially with a score of more than 25. Specifically preferred are nucleic acids containing a contiguous portion of a DNA sequence of any sequence in the sequence protocol of the present application which shows 1 or more, preferably more than 2, especially more than 5, non-identical nucleic acid residues compared to the published *Streptococcus pneumoniae* strain TIGR4 genome ({Tettelin, H. et al., 2001}; GenBank accession AE005672) and/or any other published *S. pneumoniae* genome sequence or parts thereof, especially of the strain R6 ({Hoskins, J. et al., 2001}; GenBank accession AE007317). Specifically preferred non-identical nucleic acid residues are residues, which lead to a non-identical amino acid residue. Preferably, the nucleic acid sequences encode for polypeptides having at least 1, preferably at least 2, preferably at least 3 different amino acid residues compared to the published *S. pneumoniae* counterparts mentioned above. Also such isolated polypeptides, being fragments of the proteins (or the whole protein) mentioned herein e.g. in the sequence listing, having at least 6, 7, or 8 amino acid residues and being encoded by these nucleic acids are preferred.

The nucleic acid molecule according to the present invention can as a fourth alternative also be a nucleic acid molecule which anneals under stringent hybridisation conditions to any of the nucleic acids of the present invention according to the above outlined first, second, and third alternative. Stringent hybridisation conditions are typically those described herein.

Finally, the nucleic acid molecule according to the present invention can as a fifth alternative also be a nucleic acid molecule which, but for the degeneracy of the genetic code, would hybridise to any of the nucleic acid molecules according to any nucleic acid molecule of the present invention according to the first, second, third, and fourth alternative as outlined above. This kind of nucleic acid molecule refers to the fact that preferably the nucleic acids according to the present invention code for the hyperimmune serum reactive antigens or fragments thereof according to the present invention. This kind of nucleic acid molecule is particularly useful in the detection of a nucleic acid molecule according to the present invention and thus the diagnosis of the respective microorganisms such as *S. pneumoniae* and any disease or diseased condition where this kind of microorganisms is involved. Preferably, the hybridisation would occur or be preformed under stringent conditions as described in connection with the fourth alternative described above.

Nucleic acid molecule as used herein generally refers to any ribonucleic acid molecule or deoxyribonucleic acid molecule, which may be unmodified RNA or DNA or modified RNA or DNA. Thus, for instance, nucleic acid molecule as used herein refers to, among other, single- and double-stranded DNA, DNA that is a mixture of single- and double-stranded RNA, and RNA that is a mixture of single- and double-stranded regions, hybrid molecules comprising DNA and RNA that may be single-stranded or, more typically, double-stranded, or triple-stranded, or a mixture of single- and double-stranded regions. In addition, nucleic acid molecule as used herein refers to triple-stranded regions comprising RNA or DNA or both RNA and DNA. The strands in such regions may be from the same molecule or from different molecules. The regions may include all of one or more of the molecules, but more typically involve only a region of some of the molecules. One of the molecules of a triple-helical region often is an oligonucleotide. As used herein, the term nucleic acid molecule includes DNAs or RNAs as described above that contain one or more modified bases. Thus, DNAs or RNAs with backbones modified for stability or for other reasons are "nucleic acid molecule" as that term is intended herein. Moreover, DNAs or RNAs comprising unusual bases, such as inosine, or modified bases, such as tritylated bases, to name just two examples, are nucleic acid molecule as the term is used herein. It will be appreciated that a great variety of modifications have been made to DNA and RNA that serve many useful purposes known to those of skill in the art. The term nucleic acid molecule as it is employed herein embraces such chemically, enzymatically or metabolically modified forms of nucleic acid molecule, as well as the chemical forms of DNA and RNA characteristic of viruses and cells, including simple and complex cells, inter alia. The term nucleic acid molecule also embraces short nucleic acid molecules often referred to as oligonucleotide(s). "Polynucleotide" and "nucleic acid" or "nucleic acid molecule" are often used interchangeably herein.

Nucleic acid molecules provided in the present invention also encompass numerous unique fragments, both longer and shorter than the nucleic acid molecule sequences set forth in the sequencing listing of the *S. pneumoniae* coding regions, which can be generated by standard cloning methods. To be unique, a fragment must be of sufficient size to distinguish it from other known nucleic acid sequences, most readily determined by comparing any selected *S. pneumoniae* fragment to the nucleotide sequences in computer databases such as GenBank.

Additionally, modifications can be made to the nucleic acid molecules and polypeptides that are encompassed by the present invention. For example, nucleotide substitutions can be made which do not affect the polypeptide encoded by the nucleic acid, and thus any nucleic acid molecule which encodes a hyperimmune serum reactive antigen or fragments thereof is encompassed by the present invention.

Furthermore, any of the nucleic acid molecules encoding hyperimmune serum reactive antigens or fragments thereof provided by the present invention can be functionally linked, using standard techniques such as standard cloning techniques, to any desired regulatory sequences, whether a *S. pneumoniae* regulatory sequence or a heterologous regulatory sequence, heterologous leader sequence, heterologous marker sequence or a heterologous coding sequence to create a fusion protein.

Nucleic acid molecules of the present invention may be in the form of RNA, such as mRNA or cRNA, or in the form of DNA, including, for instance, cDNA and genomic DNA obtained by cloning or produced by chemical synthetic techniques or by a combination thereof. The DNA may be triple-stranded, double-stranded or single-stranded. Single-stranded DNA may be the coding strand, also known as the sense strand, or it may be the non-coding strand, also referred to as the anti-sense strand.

The present invention further relates to variants of the herein above described nucleic acid molecules which encode fragments, analogs and derivatives of the hyperimmune serum reactive antigens and fragments thereof having a deducted *S. pneumoniae* amino acid sequence set forth in the Sequence Listing. A variant of the nucleic acid molecule may be a naturally occurring variant such as a naturally occurring allelic variant, or it may be a variant that is not known to occur naturally. Such non-naturally occurring variants of the nucleic acid molecule may be made by mutagenesis techniques, including those applied to nucleic acid molecules, cells or organisms.

Among variants in this regard are variants that differ from the aforementioned nucleic acid molecules by nucleotide substitutions, deletions or additions. The substitutions, deletions or additions may involve one or more nucleotides. The variants may be altered in coding or non-coding regions or both. Alterations in the coding regions may produce conservative or non-conservative amino acid substitutions, deletions or additions. Preferred are nucleic acid molecules encoding a variant, analog, derivative or fragment, or a variant, analogue or derivative of a fragment, which have a *S. pneumoniae* sequence as set forth in the Sequence Listing, in which several, a few, 5 to 10, 1 to 5, 1 to 3, 2, 1 or no amino acid(s) is substituted, deleted or added, in any combination. Especially preferred among these are silent substitutions, additions and deletions, which do not alter the properties and activities of the *S. pneumoniae* polypeptides set forth in the Sequence Listing. Also especially preferred in this regard are conservative substitutions.

The peptides and fragments according to the present invention also include modified epitopes wherein preferably one or two of the amino acids of a given epitope are modified or replaced according to the rules disclosed in e.g. {Tourdot, S. et al., 2000}, as well as the nucleic acid sequences encoding such modified epitopes.

It is clear that also epitopes derived from the present epitopes by amino acid exchanges improving, conserving or at least not significantly impeding the T cell activating capability of the epitopes are covered by the epitopes according to the present invention. Therefore the present epitopes also cover epitopes, which do not contain the original sequence as derived from *S. pneumoniae*, but trigger the same or preferably an improved T cell response. These epitope are referred to as “heteroclitic”; they need to have a similar or preferably greater affinity to MHC/HLA molecules, and the need the ability to stimulate the T cell receptors (TCR) directed to the original epitope in a similar or preferably stronger manner.

Heteroclitic epitopes can be obtained by rational design i.e. taking into account the contribution of individual residues to binding to MHC/HLA as for instance described by {Rammensee, H. et al., 1999}, combined with a systematic exchange of residues potentially interacting with the TCR and testing the resulting sequences with T cells directed against the original epitope. Such a design is possible for a skilled man in the art without much experimentation.

Another possibility includes the screening of peptide libraries with T cells directed against the original epitope. A preferred way is the positional scanning of synthetic peptide libraries. Such approaches have been described in detail for instance by {Hemmer, B. et al., 1999} and the references given therein.

As an alternative to epitopes represented by the present derived amino acid sequences or heteroclitic epitopes, also substances mimicking these epitopes e.g. “peptidemimetica” or “retro-inverso-peptides” can be applied.

Another aspect of the design of improved epitopes is their formulation or modification with substances increasing their capacity to stimulate T cells. These include T helper cell epitopes, lipids or liposomes or preferred modifications as described in WO 01/78767.

Another way to increase the T cell stimulating capacity of epitopes is their formulation with immune stimulating substances for instance cytokines or chemokines like interleukin-2, -7, -12, -18, class I and II interferons (IFN), especially IFN-gamma, GM-CSF, TNF-alpha, flt3-ligand and others.

As discussed additionally herein regarding nucleic acid molecule assays of the invention, for instance, nucleic acid molecules of the invention as discussed above, may be used as a hybridization probe for RNA, cDNA and genomic DNA to isolate full-length cDNAs and genomic clones encoding polypeptides of the present invention and to isolate cDNA and genomic clones of other genes that have a high sequence similarity to the nucleic acid molecules of the present invention. Such probes generally will comprise at least 15 bases. Preferably, such probes will have at least 20, at least 25 or at least 30 bases, and may have at least 50 bases. Particularly preferred probes will have at least 30 bases, and will have 50 bases or less, such as 30, 35, 40, 45, or 50 bases.

For example, the coding region of a nucleic acid molecule of the present invention may be isolated by screening a relevant library using the known DNA sequence to synthesize an oligonucleotide probe. A labeled oligonucleotide having a sequence complementary to that of a gene of the present invention is then used to screen a library of cDNA, genomic DNA or mRNA to determine to which members of the library the probe hybridizes.

The nucleic acid molecules and polypeptides of the present invention may be employed as reagents and materials for development of treatments of and diagnostics for disease, particularly human disease, as further discussed herein relating to nucleic acid molecule assays, inter alia.

The nucleic acid molecules of the present invention that are oligonucleotides can be used in the processes herein as described, but preferably for PCR, to determine whether or not the *S. pneumoniae* genes identified herein in whole or in part are present and/or transcribed in infected tissue such as blood. It is recognized that such sequences will also have utility in diagnosis of the stage of infection and type of infection the pathogen has attained. For this and other purposes the arrays comprising at least one of the nucleic acids according to the present invention as described herein, may be used.

The nucleic acid molecules according to the present invention may be used for the detection of nucleic acid molecules and organisms or samples containing these nucleic acids. Preferably such detection is for diagnosis, more preferable for the diagnosis of a disease related or linked to the present or abundance of *S. pneumoniae.*

Eukaryotes (herein also “individual(s)”), particularly mammals, and especially humans, infected with *S. pneumoniae* may be identifiable by detecting any of the nucleic acid molecules according to the present invention detected at the DNA level by a variety of techniques. Preferred nucleic acid molecules candidates for distinguishing a *S. pneumoniae* from other organisms can be obtained.

The invention provides a process for diagnosing disease, arising from infection with *S. pneumoniae*, comprising determining from a sample isolated or derived from an individual an increased level of expression of a nucleic acid molecule having the sequence of a nucleic acid molecule set forth in the Sequence Listing. Expression of nucleic acid molecules can be measured using any one of the methods well known in the art for the quantitation of nucleic acid molecules, such as, for example, PCR, RT-PCR, Rnase protection, Northern blotting, other hybridisation methods and the arrays described herein.

Isolated as used herein means separated “by the hand of man” from its natural state; i.e., that, if it occurs in nature, it has been changed or removed from its original environment, or both. For example, a naturally occurring nucleic acid molecule or a polypeptide naturally present in a living organism in its natural state is not “isolated,” but the same nucleic acid molecule or polypeptide separated from the coexisting materials of its natural state is “isolated”, as the term is employed herein. As part of or following isolation, such nucleic acid molecules can be joined to other nucleic acid molecules, such as DNAs, for mutagenesis, to form fusion proteins, and for propagation or expression in a host, for instance. The isolated nucleic acid molecules, alone or joined to other nucleic acid molecules such as vectors, can be introduced into host cells, in culture or in whole organisms. Introduced into host cells in culture or in whole organisms, such DNAs still would be isolated, as the term is used herein, because they would not be in their naturally occurring form or environment. Similarly, the nucleic acid molecules and polypeptides may occur in a composition, such as a media formulations, solutions for introduction of nucleic acid molecules or polypeptides, for example, into cells, compositions or solutions for chemical or enzymatic reactions, for instance, which are not naturally occurring compositions, and, therein remain isolated nucleic acid molecules or polypeptides within the meaning of that term as it is employed herein.

The nucleic acids according to the present invention may be chemically synthesized. Alternatively, the nucleic acids can be isolated from S. pneumoniae by methods known to the one skilled in the art.

According to another aspect of the present invention, a comprehensive set of novel hyperimmune serum reactive antigens and fragments thereof are provided by using the herein described antigen identification method. In a preferred embodiment of the invention, a hyperimmune serum-reactive antigen comprising an amino acid sequence being encoded by any one of the nucleic acids molecules herein described and fragments thereof are provided. In another preferred embodiment of the invention a novel set of hyperimmune serum-reactive antigens which comprises amino acid sequences selected from a group consisting of the polypeptide sequences as represented in Seq ID No 145, 245-288 and fragments thereof are provided. In a further preferred embodiment of the invention hyperimmune serum-reactive antigens which comprise amino acid sequences selected from a group consisting of the polypeptide sequences as represented in Seq ID No 146-150, 152, 154-160, 162-167, 169-175, 178, 180, 182-186, 188, 191-192, 195, 197, 199-206, 208, 211, 215-220, 222-223, 225-238, 240-244 and fragments thereof are provided. In a still preferred embodiment of the invention hyperimmune serum-reactive antigens which comprise amino acid sequences selected from a group consisting of the polypeptide sequences as represented in Seq ID No 153, 161, 168, 176, 181, 187, 196, 198, 209-210, 214, 224 and fragments thereof are provided.

The hyperimmune serum reactive antigens and fragments thereof as provided in the invention include any polypeptide set forth in the Sequence Listing as well as polypeptides which have at least 70% identity to a polypeptide set forth in the Sequence Listing, preferably at least 80% or 85% identity to a polypeptide set forth in the Sequence Listing, and more preferably at least 90% similarity (more preferably at least 90% identity) to a polypeptide set forth in the Sequence Listing and still more preferably at least 95%, 96%, 97%, 98%, 99% or 99.5% similarity (still more preferably at least 95%, 96%, 97%, 98%, 99%, or 99.5% identity) to a polypeptide set forth in the Sequence Listing and also include portions of such polypeptides with such portion of the polypeptide generally containing at least 4 amino acids and more preferably at least 8, still more preferably at least 30, still more preferably at least 50 amino acids, such as 4, 8, 10, 20, 30, 35, 40, 45 or 50 amino acids.

The invention also relates to fragments, analogs, and derivatives of these hyperimmune serum reactive antigens and fragments thereof. The terms "fragment", "derivative" and "analog" when referring to an antigen whose amino acid sequence is set forth in the Sequence Listing, means a polypeptide which retains essentially the same or a similar biological function or activity as such hyperimmune serum reactive antigen and fragment thereof.

The fragment, derivative or analog of a hyperimmune serum reactive antigen and fragment thereof may be 1) one in which one or more of the amino acid residues are substituted with a conserved or non-conserved amino acid residue (preferably a conserved amino acid residue) and such substituted amino acid residue may or may not be one encoded by the genetic code, or 2) one in which one or more of the amino acid residues includes a substituent group, or 3) one in which the mature hyperimmune serum reactive antigen or fragment thereof is fused with another compound, such as a compound to increase the half-life of the hyperimmune serum reactive antigen and fragment thereof (for example, polyethylene glycol), or 4) one in which the additional amino acids are fused to the mature hyperimmune serum reactive antigen or fragment thereof, such as a leader or secretory sequence or a sequence which is employed for purification of the mature hyperimmune serum reactive antigen or fragment thereof or a proprotein sequence. Such fragments, derivatives and analogs are deemed to be within the scope of those skilled in the art from the teachings herein.

The present invention also relates to antigens of different S. pneumoniae isolates. Such homologues may easily be isolated based on the nucleic acid and amino acid sequences disclosed herein. There are more than 90 serotypes in more than 40 serogroups distinguished to date and the typing is based on serotype specific antisera. The presence of any antigen can accordingly be determined for every serotype. In addition it is possible to determine the variability of a particular antigen in the various serotypes as described for the S. pyogenes sic gene {Hoe, N. et al., 2001}. The contribution of the various serotypes to the different pneumococcal infections varies in the different age groups and geographical regions {Gray, B. et al., 1979}; {Gray, B. et al., 1986}; {Orange, M. et al., 1993}, reviewed in Epidemiology and Prevention of Vaccine-Preventable Diseases, 7th Edition-Second Printing, The Pink Book). It is an important aspect that the most valuable protective antigens are expected to be conserved among various clinical strains.

Among the particularly preferred embodiments of the invention in this regard are the hyperimmune serum reactive antigens set forth in the Sequence Listing, variants, analogs, derivatives and fragments thereof, and variants, analogs and derivatives of fragments. Additionally, fusion polypeptides comprising such hyperimmune serum reactive antigens, variants, analogs, derivatives and fragments thereof, and variants, analogs and derivatives of the fragments are also encompassed by the present invention. Such fusion polypeptides and proteins, as well as nucleic acid molecules encoding them, can readily be made using standard techniques, including standard recombinant techniques for producing and expression of a recombinant polynucleic acid encoding a fusion protein.

Among preferred variants are those that vary from a reference by conservative amino acid substitutions. Such substitutions are those that substitute a given amino acid in a polypeptide by another amino acid of like characteristics. Typically seen as conservative substitutions are the replacements, one for another, among the aliphatic amino acids Ala, Val, Leu and Ile; interchange of the hydroxyl residues Ser and Thr, exchange of the acidic residues Asp and Glu, substitution between the amide residues Asn and Gln, exchange of the basic residues Lys and Arg and replacements among the aromatic residues Phe and Tyr.

Further particularly preferred in this regard are variants, analogs, derivatives and fragments, and variants, analogs and derivatives of the fragments, having the amino acid sequence of any polypeptide set forth in the Sequence Listing, in which several, a few, 5 to 10, 1 to 5, 1 to 3, 2, 1 or no amino acid residues are substituted, deleted or added, in any combination. Especially preferred among these are silent substitutions, additions and deletions, which do not alter the properties and activities of the polypeptide of the present invention. Also especially preferred in this regard are conservative substitutions. Most highly preferred are polypeptides having an amino acid sequence set forth in the Sequence Listing without substitutions.

The hyperimmune serum reactive antigens and fragments thereof of the present invention are preferably provided in an isolated form, and preferably are purified to homogeneity.

Also among preferred embodiments of the present invention are polypeptides comprising fragments of the polypeptides having the amino acid sequence set forth in the Sequence Listing, and fragments of variants and derivatives of the polypeptides set forth in the Sequence Listing.

In this regard a fragment is a polypeptide having an amino acid sequence that entirely is the same as part but not all of the amino acid sequence of the afore mentioned hyperimmune serum reactive antigen and fragment thereof, and variants or derivative, analogs, fragments thereof. Such fragments may be "free-standing", i.e., not part of or fused to other amino acids or polypeptides, or they may be comprised within a larger polypeptide of which they form a part or region. Also preferred in this aspect of the invention are fragments characterised by structural or functional attributes of the polypeptide of the present invention, i.e. fragments that comprise alpha-helix and alpha-helix forming regions, beta-sheet and beta-sheet forming regions, turn and turn-forming regions, coil and coil-forming regions, hydrophilic regions, hydrophobic regions, alpha amphipathic regions, beta-amphipathic regions, flexible regions, surface-forming regions, substrate binding regions, and high antigenic index regions of the polypeptide of the present invention, and combinations of such fragments. Preferred regions are those that mediate activities of the hyperimmune serum reactive antigens and fragments thereof of the present invention. Most highly preferred in this regard are fragments that have a chemical, biological or other activity of the hyperimmune serum reactive antigen and fragments thereof of the present invention, including those with a similar activity or an improved activity, or with a decreased undesirable activity. Particularly preferred are fragments comprising receptors or domains of enzymes that confer a function essential for viability of S. pneumoniae or the ability to cause disease in humans. Further preferred polypeptide fragments are those that comprise or contain antigenic or immunogenic determinants in an animal, especially in a human.

An antigenic fragment is defined as a fragment of the identified antigen, which is for itself antigenic or may be made antigenic when provided as a hapten. Therefore, also antigens or antigenic fragments showing one or (for longer fragments) only a few amino acid exchanges are enabled with the present invention, provided that the antigenic capacities of such fragments with amino acid exchanges are not severely deteriorated on the exchange(s), i.e., suited for eliciting an appropriate immune response in an individual vaccinated with this antigen and identified by individual antibody preparations from individual sera.

Preferred examples of such fragments of a hyperimmune serum-reactive antigen are selected from the group consisting of peptides comprising amino acid sequences of column "predicted immunogenic aa", and "Location of identified immunogenic region" of Table 1; the serum reactive epitopes of Table 2, especially peptides comprising amino acid 4-11, 35-64, 66-76, 101-108, 111-119 and 57-114 of Seq ID No 145; 5-27, 32-64, 92-102, 107-113, 119-125, 133-139, 148-162, 177-187, 195-201, 207-214, 241-251, 254-269, 285-300, 302-309, 317-324, 332-357, 365-404, 411-425, 443-463, 470-477, 479-487, 506-512, 515-520, 532-547, 556-596, 603-610, 616-622, 624-629, 636-642, 646-665, 667-674, 687-692, 708-720, 734-739, 752-757, 798-820, 824-851, 856-865 and 732-763 of Seq ID No 146; 14-21, 36-44, 49-66, 102-127, 162-167, 177-196, 45-109 and 145-172 of Seq ID No 147; 17-35, 64-75, 81-92, 100-119, 125-172, 174-183, 214-222, 230-236, 273-282, 287-303, 310-315, 331-340, 392-398, 412-420, 480-505, 515-523, 525-546, 553-575, 592-598, 603-609, 617-625, 631-639, 644-651, 658-670, 681-687, 691-704, 709-716, 731-736, 739-744, 750-763, 774-780, 784-791, 799-805, 809-822, 859-870, 880-885, 907-916, 924-941, 943-949, 973-986, 1010-1016, 1026-1036, 1045-1054, 1057-1062, 1082-1088, 1095-1102, 1109-1120, 1127-1134, 1140-1146, 1152-1159, 1169-1179, 1187-1196, 1243-1251, 1262-1273, 1279-1292, 1306-1312, 1332-1343, 1348-1364, 1379-1390, 1412-1420, 1427-1436, 1458-1468, 1483-1503, 1524-1549, 1574-1588, 1614-1619, 1672-1685, 1697-1707, 1711-1720, 1738-1753, 1781-1787, 1796-1801, 1826-1843, 132-478, 508-592 and 1753-1810 of Seq ID No 148; 15-43, 49-55, 71-77, 104-110, 123-130, 162-171, 180-192, 199-205, 219-227, 246-254, 264-270, 279-287, 293-308, 312-322, 330-342, 349-356, 369-377, 384-394, 401-406, 416-422, 432-439, 450-460, 464-474, 482-494, 501-508, 521-529, 536-546, 553-558, 568-574, 584-591, 602-612, 616-626, 634-646, 653-660, 673-681, 688-698, 705-710, 720-726, 736-749, 833-848, 1-199, 200-337, 418-494 and 549-647 of Seq ID No 149; 9-30, 65-96, 99-123, 170-178 and 1-128 of Seq ID No 150; 7-32, 34-41, 96-106, 127-136, 154-163, 188-199, 207-238, 272-279, 306-312, 318-325, 341-347, 353-360, 387-393, 399-406, 434-440, 452-503, 575-580, 589-601, 615-620, 635-640, 654-660, 674-680, 696-701, 710-731, 1-548 and 660-691 of Seq ID No 151; 4-19, 35-44, 48-59, 77-87, 93-99, 106-111, 130-138, 146-161 and 78-84 of Seq ID No 152; 24-30, 36-43, 64-86, 93-99, 106-130, 132-145, 148-165, 171-177, 189-220, 230-249, 251-263, 293-300, 302-312, 323-329, 338-356, 369-379, 390-412 and 179-193 of Seq ID No 153; 30-39, 61-67, 74-81, 90-120, 123-145, 154-167, 169-179, 182-197, 200-206, 238-244, 267-272 and 230-265 of Seq ID No 154; 14-20, 49-65, 77-86 and 2-68 of Seq ID No 155; 4-9, 26-35, 42-48, 53-61, 63-85, 90-101, 105-111, 113-121, 129-137, 140-150, 179-188, 199-226, 228-237, 248-255, 259-285, 299-308, 314-331, 337-343, 353-364, 410-421, 436-442 and 110-144 of Seq ID No 156; 36-47, 55-63, 94-108, 129-134, 144-158, 173-187, 196-206, 209-238, 251-266, 270-285, 290-295, 300-306, 333-344, 346-354, 366-397, 404-410, 422-435, 439-453, 466-473, 515-523, 529-543, 554-569, 571-585, 590-596, 607-618, 627-643, 690-696, 704-714, 720-728, 741-749, 752-767, 780-799, 225-247 and 480-507 of Seq ID No 157; 16-25, 36-70, 80-93, 100-106 and 78-130 of Seq ID No 158; 18-27, 41-46, 50-57, 65-71, 79-85, 93-98, 113-128, 144-155, 166-178, 181-188, 201-207, 242-262, 265-273, 281-295, 303-309, 318-327 and 36-64 of Seq ID No 159; 7-29, 31-44, 50-59, 91-96, 146-153, 194-201, 207-212, 232-238, 264-278, 284-290, 296-302, 326-353, 360-370, 378-384, 400-405, 409-418, 420-435, 442-460, 499-506, 529-534, 556-562, 564-576, 644-651, 677-684, 687-698, 736-743, 759-766, 778-784, 808-814, 852-858, 874-896, 920-925, 929-935, 957-965, 1003-1012, 1021-1027, 1030-1044, 1081-1087, 1101-1111, 1116-1124, 1148-1159, 1188-1196, 1235-1251, 1288-1303, 1313-1319, 1328-1335, 1367-1373, 1431-1437, 1451-1458, 1479-1503, 1514-1521, 1530-1540, 1545-1552, 1561-1568, 1598-1605, 1617-1647, 1658-1665, 1670-1676, 1679-1689, 1698-1704, 1707-1713, 1732-1738, 1744-1764, 1-70, 154-189, 922-941, 1445-1462 and 1483-1496 of Seq ID No 160; 6-51, 81-91, 104-113, 126-137, 150-159, 164-174, 197-209, 215-224, 229-235, 256-269, 276-282, 307-313, 317-348, 351-357, 376-397, 418-437, 454-464, 485-490, 498-509, 547-555, 574-586, 602-619 and 452-530 of Seq ID No 161; 25-31, 39-47, 49-56, 99-114, 121-127, 159-186, 228-240, 253-269, 271-279, 303-315, 365-382, 395-405, 414-425, 438-453 and 289-384 of Seq ID No 162; 9-24, 41-47, 49-54, 68-78, 108-114, 117-122, 132-140, 164-169, 179-186, 193-199, 206-213, 244-251, 267-274, 289-294, 309-314, 327-333, 209-249 and 286-336 of Seq ID No 163; 9-28, 53-67, 69-82, 87-93, 109-117, 172-177, 201-207, 220-227, 242-247, 262-268, 305-318, 320-325 and 286-306 of Seq ID No 164; 4-10, 26-39, 47-58, 63-73, 86-96, 98-108, 115-123, 137-143, 148-155, 160-176, 184-189, 194-204, 235-240, 254-259, 272-278 and 199-283 of Seq ID No 165; 4-26, 33-39, 47-53, 59-65, 76-83, 91-97, 104-112, 118-137, 155-160, 167-174, 198-207, 242-268, 273-279, 292-315, 320-332, 345-354, 358-367, 377-394, 403-410, 424-439, 445-451, 453-497, 511-518, 535-570, 573-589, 592-601, 604-610 and 202-242 of Seq ID No 166; 8-30, 36-45, 64-71, 76-82, 97-103, 105-112, 134-151, 161-183, 211-234, 253-268, 270-276, 278-284, 297-305, 309-315, 357-362, 366-372, 375-384, 401-407, 409-416, 441-455, 463-470, 475-480, 490-497, 501-513, 524-537, 552-559, 565-576, 581-590, 592-600, 619-625, 636-644, 646-656 and 316-419 of Seq ID No 167; 4-17, 52-58, 84-99, 102-110, 114-120, 124-135, 143-158, 160-173, 177-196, 201-216, 223-250, 259-267, 269-275 and 1-67 of Seq ID No 168; 6-46, 57-67, 69-80, 82-133, 137-143, 147-168, 182-187, 203-209, 214-229, 233-242, 246-280 and 53-93 of Seq ID No 169; 7-40, 50-56, 81-89, 117-123, 202-209, 213-218, 223-229, 248-261, 264-276, 281-288, 303-308, 313-324, 326-332, 340-346, 353-372, 434-443, 465-474, 514-523, 556-564, 605-616, 620-626, 631-636, 667-683, 685-699, 710-719, 726-732, 751-756, 760-771, 779-788, 815-828, 855-867, 869-879, 897-902, 917-924, 926-931, 936-942, 981-1000, 1006-1015, 1017-1028, 1030-1039, 1046-1054, 1060-1066, 1083-1092, 1099-1112, 1122-1130, 1132-1140, 1148-1158, 1161-1171, 1174-1181, 1209-1230, 1236-1244, 1248-1254, 1256-1267, 1269-1276, 1294-1299, 1316-1328, 1332-1354, 1359-1372, 1374-1380, 1384-1390, 1395-1408, 1419-1425, 1434-1446, 1453-1460, 1465-1471, 1474-1493, 1505-1515, 1523-1537, 1547-1555, 1560-1567, 1577-1605, 1633-1651, 1226-1309, 1455-1536 and 1538-1605 of Seq ID No 170; 4-10, 31-39, 81-88, 106-112, 122-135, 152-158, 177-184, 191-197, 221-227, 230-246, 249-255, 303-311, 317-326, 337-344, 346-362, 365-371, 430-437, 439-446, 453-462, 474-484 and 449-467 of Seq ID No 171; 9-15, 24-35, 47-55, 122-128, 160-177, 188-196, 202-208, 216-228, 250-261, 272-303, 318-324, 327-339, 346-352, 355-361, 368-373, 108-218 and 344-376 of Seq ID No 172; 6-14, 17-48, 55-63, 71-90, 99-109, 116-124, 181-189, 212-223, 232-268, 270-294, 297-304, 319-325, 340-348, 351-370, 372-378, 388-394, 406-415, 421-434 and 177-277 of Seq ID No 173; 21-39, 42-61, 65-75, 79-85, 108-115 and 11-38 of Seq ID No 174; 4-17, 26-39, 61-76, 103-113, 115-122, 136-142, 158-192, 197-203, 208-214, 225-230, 237-251 and 207-225 of Seq ID No 175; 5-11, 27-36, 42-53, 62-70, 74-93, 95-104, 114-119, 127-150, 153-159, 173-179, 184-193, 199-206, 222-241, 248-253, 257-280, 289-295, 313-319, 322-342, 349-365, 368-389, 393-406, 408-413, 426-438, 447-461, 463-470, 476-495, 532-537, 543-550 and 225-246 of Seq ID No 176; 4-29, 68-82, 123-130, 141-147, 149-157, 178-191, 203-215, 269-277, 300-307, 327-335, 359-370, 374-380, 382-388, 393-400, 410-417, 434-442, 483-492, 497-503, 505-513, 533-540, 564-569, 601-607, 639-647, 655-666, 693-706, 712-718, 726-736, 752-758, 763-771, 774-780, 786-799, 806-812, 820-828, 852-863, 864-892, 901-909, 925-932, 943-948, 990-996, 1030-1036, 1051-1059, 1062-1068, 1079-1086, 1105-1113, 1152-1162, 1168-1179, 1183-1191, 1204-1210, 1234-1244, 1286-1295, 1318-1326, 1396-1401, 1451-1460, 1465-1474, 1477-1483, 1488-1494, 1505-1510, 1514-1521, 1552-1565, 1593-1614, 1664-1672, 1677-1685, 1701-1711, 1734-1745, 1758-1770, 1784-1798, 1840-1847, 1852-1873, 1885-1891, 1906-1911, 1931-1939, 1957-1970, 1977-1992, 2014-2020, 2026-2032, 2116-2134, 1-348, 373-490, 573-767, 903-1043, 1155-1198, 1243-1482, 1550-1595, 1682-1719, 1793-1921 and 2008-2110 of Seq ID No 177; 10-35, 39-52, 107-112, 181-188, 226-236, 238-253, 258-268, 275-284, 296-310, 326-338, 345-368, 380-389, 391-408, 410-418, 420-429, 444-456, 489-505, 573-588, 616-623, 637-643, 726-739, 741-767, 785-791, 793-803, 830-847, 867-881, 886-922, 949-956, 961-980, 988-1004, 1009-1018, 1027-1042, 1051-1069, 1076-1089, 1108-1115, 1123-1135, 1140-1151, 1164-1179, 1182-1191, 1210-1221, 1223-1234, 1242-1250, 1255-1267, 1281-1292, 1301-1307, 1315-1340, 1348-1355, 1366-1373, 1381-1413, 1417-1428, 1437-1444, 1453-1463, 1478-1484, 1490-1496, 1498-1503, 1520-1536, 1538-1546, 1548-1570, 1593-1603, 1612-1625, 1635-1649, 1654-1660, 1670-1687, 1693-1700, 1705-1711, 1718-1726, 1729-1763, 1790-1813, 1871-1881, 1893-1900, 1907-1935, 1962-1970, 1992-2000, 2006-2013, 2033-2039, 2045-2051, 2055-2067, 2070-2095, 2097-2110, 2115-2121, 2150-2171, 2174-2180, 2197-2202, 2206-2228 and 1526-1560 of Seq ID No 178; 4-17, 35-48, 54-76, 78-107, 109-115, 118-127, 134-140, 145-156, 169-174, 217-226, 232-240, 256-262, 267-273, 316-328, 340-346, 353-360, 402-409, 416-439, 448-456, 506-531, 540-546, 570-578, 586-593, 595-600, 623-632, 662-667, 674-681, 689-705, 713-724, 730-740, 757-763, 773-778, 783-796, 829-835, 861-871, 888-899, 907-939, 941-955, 957-969, 986-1000, 1022-1028, 1036-1044, 1068-1084, 1095-1102, 1118-1124, 1140-1146, 1148-1154, 1168-1181, 1185-1190, 1197-1207, 1218-1226, 1250-1270, 1272-1281, 1284-1296, 1312-1319, 1351-1358, 1383-1409, 1422-1428, 1438-1447, 1449-1461, 1482-1489, 1504-1510, 1518-1527, 1529-1537, 1544-1551, 1569-1575, 1622-1628, 1631-1637, 1682-1689, 1711-1718, 1733-1740, 1772-1783, 1818-1834, 1859-1872, 1-64 and 128-495 of Seq ID No 179; 8-28, 32-37, 62-69, 119-125, 137-149, 159-164, 173-189, 200-205, 221-229, 240-245, 258-265, 268-276, 287-293, 296-302, 323-329 and 1-95 of Seq ID No 180; 9-18, 25-38, 49-63, 65-72, 74-81, 94-117, 131-137, 139-146, 149-158, 162-188, 191-207, 217-225, 237-252, 255-269, 281-293, 301-326, 332-342, 347-354, 363-370, 373-380, 391-400, 415-424, 441-447 and 75-107 of Seq ID No 181; 4-24, 64-71, 81-87, 96-116, 121-128, 130-139, 148-155, 166-173, 176-184, 203-215, 231-238, 243-248, 256-261, 280-286, 288-306, 314-329 and 67-148 of Seq ID No 182; 4-10, 19-37, 46-52, 62-81, 83-89, 115-120, 134-139, 141-151, 168-186, 197-205, 209-234, 241-252, 322-335, 339-345, 363-379, 385-393, 403-431, 434-442, 447-454, 459-465, 479-484, 487-496 and 404-420 of Seq ID No 183; 10-35, 46-66, 71-77, 84-93, 96-122, 138-148, 154-172, 182-213, 221-233, 245-263, 269-275, 295-301, 303-309, 311-320, 324-336, 340-348, 351-359, 375-381 and 111-198 of Seq ID No 184; 14-25, 30-42, 47-61, 67-75, 81-91, 98-106, 114-122, 124-135, 148-193, 209-227 and 198-213 of Seq ID No 185; 5-18, 45-50, 82-90, 97-114, 116-136, 153-161, 163-171, 212-219, 221-227, 240-249, 267-281, 311-317, 328-337, 375-381, 390-395, 430-436, 449-455, 484-495, 538-543, 548-554, 556-564, 580-586, 596-602 and 493-606 of Seq ID No 186; 9-25, 28-34, 37-44, 61-68, 75-81, 88-96, 98-111, 119-133, 138-150, 152-163, 168-182, 186-194, 200-205, 216-223, 236-245, 257-264, 279-287, 293-304, 311-318, 325-330, 340-346, 353-358, 365-379, 399-409, 444-453 and 303-391 of Seq ID No 187; 16-36, 55-61, 66-76, 78-102, 121-130, 134-

146, 150-212, 221-239, 255-276, 289-322, 329-357 and 29-59 of Seq ID No 188; 8-27, 68-74, 77-99, 110-116, 124-141, 171-177, 202-217, 221-228, 259-265, 275-290, 293-303, 309-325, 335-343, 345-351, 365-379, 384-394, 406-414, 423-437, 452-465, 478-507, 525-534, 554-560, 611-624, 628-651, 669-682, 742-747, 767-778, 782-792, 804-812, 820-836, 79-231 and 359-451 of Seq ID No 189; 5-28, 39-45, 56-62, 67-74, 77-99, 110-117, 124-141, 168-176, 200-230, 237-244, 268-279, 287-299, 304-326, 329-335, 348-362, 370-376, 379-384, 390-406, 420-429, 466-471, 479-489, 495-504, 529-541, 545-553, 561-577, 598-604, 622-630, 637-658, 672-680, 682-688, 690-696, 698-709, 712-719, 724-736, 738-746, 759-769, 780-786, 796-804, 813-818, 860-877, 895-904, 981-997, 1000-1014, 1021-1029, 1-162, 206-224, 254-350, 414-514 and 864-938 of Seq ID No 190; 4-11, 19-49, 56-66, 68-101, 109-116, 123-145, 156-165, 177-185, 204-221, 226-234, 242-248, 251-256, 259-265, 282-302, 307-330, 340-349, 355-374, 377-383, 392-400, 422-428, 434-442, 462-474 and 266-322 of Seq ID No 191; 14-43, 45-57, 64-74, 80-87, 106-127, 131-142, 145-161, 173-180, 182-188, 203-210, 213-219, 221-243, 245-254, 304-311, 314-320, 342-348, 354-365, 372-378, 394-399, 407-431, 436-448, 459-465, 470-477, 484-490, 504-509, 531-537, 590-596, 611-617, 642-647, 723-734, 740-751, 754-762, 764-774, 782-797, 807-812, 824-831, 838-845, 877-885, 892-898, 900-906, 924-935, 940-946, 982-996, 1006-1016, 1033-1043, 1051-1056, 1058-1066, 1094-1108, 1119-1126, 1129-1140, 1150-1157, 1167-1174, 1176-1185, 1188-1201, 1209-1216, 1220-1228, 1231-1237, 1243-1248, 1253-1285, 1288-1297, 1299-1307, 1316-1334, 1336-1343, 1350-1359, 1365-1381, 1390-1396, 1412-1420, 1427-1439, 1452-1459, 1477-1484, 1493-1512, 1554-1559, 1570-1578, 1603-1608, 1623-1630, 1654-1659, 1672-1680, 1689-1696, 1705-1711, 1721-1738, 1752-1757, 1773-1780, 1817-1829, 1844-1851, 1856-1863, 1883-1895, 1950-1958, 1974-1990, 172-354, 384-448, 464-644, 648-728 and 1357-1370 of Seq ID No 192; 8-27, 68-74, 77-99, 110-124-141, 169-176, 201-216, 220-227, 258-264, 274-289, 292-302, 308-324, 334-342, 344-350, 364-372, 377-387, 399-407, 416-429, 445-458, 471-481, 483-500, 518-527, 547-553, 604-617, 621-644, 662-675, 767-778, 809-816, 15-307, 350-448 and 496-620 of Seq ID No 193; 4-17, 24-29, 53-59, 62-84, 109-126, 159-164, 189-204, 208-219, 244-249, 274-290, 292-302, 308-324, 334-342, 344-350, 378-389, 391-397, 401-409, 424-432, 447-460, 470-479, 490-504, 521-529, 538-544, 549-555, 570-577, 583-592, 602-608, 615-630, 635-647, 664-677, 692-698, 722-731, 733-751, 782-790, 793-799, 56-267, 337-426 and 495-601 of Seq ID No 194; 12-22, 49-59, 77-89, 111-121, 136-148, 177-186, 207-213, 217-225, 227-253, 259-274, 296-302, 328-333, 343-354, 374-383, 424-446, 448-457, 468-480, 488-502, 507-522, 544-550, 553-560, 564-572, 587-596, 604-614, 619-625, 629-635, 638-656, 662-676, 680-692, 697-713, 720-738, 779-786, 833-847, 861-869, 880-895, 897-902, 911-917, 946-951, 959-967, 984-990, 992-1004, 1021-1040, 1057-1067, 1073-1080 and 381-403 of Seq ID No 195; 4-10, 26-31, 46-56, 60-66, 70-79, 86-94, 96-102, 109-118, 132-152, 164-187, 193-206, 217-224 and 81-149 of Seq ID No 196; 4-21, 26-37, 48-60, 71-82, 109-117, 120-128, 130-136, 142-147, 181-187, 203-211, 216-223, 247-255, 257-284, 316-325, 373-379, 395-400, 423-435, 448-456, 479-489, 512-576, 596-625, 641-678, 680-688, 692-715 and 346-453 of Seq ID No 197; 10-16, 25-31, 34-56, 58-69, 71-89, 94-110, 133-176, 186-193, 208-225, 240-250, 259-266, 302-307, 335-341, 376-383, 410-416 and 316-407 of Seq ID No 198; 11-29, 42-56, 60-75, 82-88, 95-110, 116-126, 132-143, 145-160, 166-172, 184-216 and 123-164 of Seq ID No 199; 11-29, 54-63, 110-117, 139-152, 158-166, 172-180, 186-193, 215-236, 240-251, 302-323, 330-335, 340-347, 350-366, 374-381 and 252-299 of Seq ID No 200; 18-27, 35-42, 50-56, 67-74, 112-136, 141-153, 163-171, 176-189, 205-213, 225-234, 241-247, 253-258, 269-281, 288-298, 306-324, 326-334, 355-369, 380-387 and 289-320 of Seq ID No 201; 7-15, 19-41, 56-72, 91-112, 114-122, 139-147, 163-183, 196-209, 258-280, 326-338, 357-363, 391-403, 406-416 and 360-378 of Seq ID No 202; 11-18, 29-41, 43-49, 95-108, 142-194, 204-212, 216-242, 247-256, 264-273 and 136-149 of Seq ID No 203; 18-24, 33-40, 65-79, 89-102, 113-119, 130-137, 155-161, 173-179, 183-203, 205-219, 223-231, 245-261, 267-274, 296-306, 311-321, 330-341, 344-363, 369-381, 401-408, 415-427, 437-444, 453-464, 472-478, 484-508, 517-524, 526-532, 543-548 and 59-180 of Seq ID No 204; 5-13, 52-65, 67-73, 97-110, 112-119, 134-155 and 45-177 of Seq ID No 205; 6-28, 34-43, 57-67, 75-81, 111-128, 132-147, 155-163, 165-176, 184-194, 208-216, 218-229, 239-252, 271-278, 328-334, 363-376, 381-388, 426-473, 481-488, 492-498, 507-513, 536-546, 564-582, 590-601, 607-623, 148-269, 420-450 and 610-648 of Seq ID No 206; 4-12, 20-38, 69-75, 83-88, 123-128, 145-152, 154-161, 183-188, 200-213, 245-250, 266-272, 306-312, 332-339, 357-369, 383-389, 395-402, 437-453, 455-470, 497-503 and 1-112 of Seq ID No 207; 35-59, 74-86, 111-117, 122-137 and 70-154 of Seq ID No 208; 26-42, 54-61, 65-75, 101-107, 123-130, 137-144, 148-156, 164-172, 177-192, 213-221, 231-258 and 157-249 of Seq ID No 209; 29-38, 61-67, 77-87, 94-100, 105-111, 118-158 and 1-97 of Seq ID No 210; 7-21, 30-48, 51-58, 60-85, 94-123, 134-156, 160-167, 169-183, 186-191, 216-229, 237-251, 257-267, 272-282, 287-298 and 220-243 of Seq ID No 211; 6-29, 34-47, 56-65, 69-76, 83-90, 123-134, 143-151, 158-178, 197-203, 217-235, 243-263, 303-309, 320-333, 338-348, 367-373, 387-393, 407-414, 416-427, 441-457, 473-482, 487-499, 501-509, 514-520, 530-535, 577-583, 590-602, 605-612, 622-629, 641-670, 678-690, 37-71 and 238-307 of Seq ID No 212; 7-40, 121-132, 148-161, 196-202, 209-215, 221-235, 248-255, 271-280, 288-295, 330-339, 395-409, 414-420, 446-451, 475-487, 556-563, 568-575, 580-586, 588-595, 633-638, 643-648, 652-659, 672-685, 695-700, 710-716, 737-742, 749-754, 761-767, 775-781, 796-806, 823-835, 850-863, 884-890, 892-900, 902-915, 934-941 and 406-521 of Seq ID No 213; 9-18, 24-46, 51-58, 67-77, 85-108, 114-126, 129-137, 139-146, 152-165, 173-182, 188-195, 197-204, 217-250, 260-274, 296-313, 343-366, 368-384, 427-434, 437-446, 449-455, 478-484, 492-506, 522-527, 562-591, 599-606, 609-618, 625-631, 645-652 and 577-654 of Seq ID No 214; 13-20, 26-37, 41-53, 56-65, 81-100, 102-114, 118-127, 163-188, 196-202, 231-238, 245-252, 266-285, 293-298, 301-306 and 19-78 of Seq ID No 215; 10-23, 32-42, 54-66, 73-91, 106-113, 118-127, 139-152, 164-173, 198-207, 210-245, 284-300, 313-318, 330-337, 339-346, 354-361, 387-393, 404-426, 429-439, 441-453, 467-473, 479-485, 496-509, 536-544, 551-558, 560-566, 569-574, 578-588, 610-615, 627-635, 649-675, 679-690, 698-716, 722-734, 743-754, 769-780, 782-787 and 480-550 of Seq ID No 216; 6-39, 42-50, 60-68, 76-83, 114-129, 147-162, 170-189, 197-205, 217-231, 239-248, 299-305, 338-344, 352-357, 371-377, 380-451, 459-483, 491-499, 507-523, 537-559, 587-613, 625-681, 689-729, 737-781, 785-809, 817-865, 873-881, 889-939, 951-975, 983-1027, 1031-1055, 1063-1071, 1079-1099, 1103-1127, 1151-1185, 1197-1261, 1269-1309, 1317-1333, 1341-1349, 1357-1465, 1469-1513, 1517-1553, 1557-1629, 1637-1669, 1677-1701, 1709-1725, 1733-1795, 1823-1849, 1861-1925, 1933-1973, 1981-2025, 2029-2053, 2061-2109, 2117-2125, 2133-2183, 2195-2219, 2227-2271, 2275-2299, 2307-2315, 2323-2343, 2347-2371, 2395-2429, 2441-2529, 2537-2569, 2577-2601, 2609-2625, 2633-2695, 2699-2737, 2765-2791, 2803-2867, 2889-2913, 2921-2937, 2945-2969, 2977-2985, 2993-3009, 3023-3045, 3073-3099, 3111-3167, 3175-3215, 3223-3267, 3271-3295, 3303-3351, 3359-3367, 3375-3425, 3437-3461, 3469-3513, 3517-3541, 3549-3557, 3565-3585, 3589-3613, 3637-3671, 3683-3747, 3755-3795, 3803-3819, 3827-3835, 3843-3951, 3955-3999, 4003-4039, 4043-4115, 4123-4143, 4147-4171, 4195-4229, 4241-4305, 4313-4353, 4361-4377, 4385-4393, 4401-4509, 4513-4557, 4561-4597, 4601-4718, 4749-4768, 74-171, 452-559 and 2951-3061 of Seq ID No 217; 16-22, 30-51, 70-111, 117-130, 137-150, 171-178, 180-188, 191-196 and 148-181 of Seq ID No 218; 6-19, 21-46, 50-56, 80-86, 118-126, 167-186, 189-205, 211-242, 244-267, 273-286, 290-297, 307-316, 320-341 and 34-60 of Seq ID No 219; 5-26, 33-43, 48-54, 58-63, 78-83, 113-120, 122-128, 143-152, 157-175, 185-192, 211-225, 227-234, 244-256, 270-281, 284-290, 304-310, 330-337, 348-355, 362-379, 384-394, 429-445, 450-474, 483-490, 511-520, 537-546, 548-554, 561-586, 590-604, 613-629, 149-186, 285-431 and 573-659 of Seq ID No 220; 5-26, 49-59, 61-67, 83-91, 102-111, 145-157, 185-192, 267-272, 279-286, 292-298, 306-312, 134-220, 235-251 and 254-280 of Seq ID No 221; 5-19, 72-79, 83-92, 119-124, 140-145, 160-165, 167-182, 224-232, 240-252, 259-270, 301-310, 313-322, 332-343, 347-367, 384-398, 416-429, 431-446, 454-461 and 1-169 of Seq ID No 222; 8-17, 26-31, 56-62, 75-83, 93-103, 125-131, 135-141, 150-194, 205-217, 233-258, 262-268, 281-286 and 127-168 of Seq ID No 223; 6-12, 69-75, 108-115, 139-159, 176-182, 194-214 and 46-161 of Seq ID No 224; 6-13, 18-27, 39-48, 51-59, 66-73, 79-85, 95-101, 109-116, 118-124, 144-164, 166-177, 183-193, 197-204, 215-223, 227-236, 242-249, 252-259, 261-270, 289-301, 318-325 and 12-58 of Seq ID No 225; 4-10, 26-32, 48-60, 97-105, 117-132, 138-163, 169-185, 192-214, 219-231, 249-261, 264-270, 292-308, 343-356, 385-392, 398-404, 408-417, 435-441 and 24-50 of Seq ID No 226; 10-40, 42-48, 51-61, 119-126 and 1-118 of Seq ID No 227; 5-17, 40-58, 71-83, 103-111, 123-140, 167-177, 188-204 and 116-128 of Seq ID No 228; 4-9, 11-50, 57-70, 112-123, 127-138 and 64-107 of Seq ID No 229; 9-39, 51-67 and 1-101 of Seq ID No 230; 5-14, 17-25, 28-46, 52-59, 85-93, 99-104, 111-120, 122-131, 140-148, 158-179, 187-197, 204-225, 271-283, 285-293 and 139-155 of Seq ID No 231; 42-70, 73-90, 92-108, 112-127, 152-164, 166-172, 181-199, 201-210, 219-228, 247-274, 295-302, 322-334, 336-346, 353-358, 396-414, 419-425, 432-438, 462-471, 518-523, 531-536, 561-567, 576-589, 594-612, 620-631, 665-671, 697-710, 718-731, 736-756, 765-771, 784-801 and 626-653 of Seq ID No 232; 8-28, 41-51, 53-62, 68-74, 79-85, 94-100, 102-108, 114-120, 130-154, 156-162, 175-180, 198-204, 206-213, 281-294, 308-318, 321-339, 362-368, 381-386, 393-399, 407-415 and 2-13 of Seq ID No 233; 4-39, 48-65, 93-98, 106-112, 116-129 and 10-36 of Seq ID No 234; 25-32, 35-50, 66-71, 75-86, 90-96, 123-136, 141-151, 160-179, 190-196, 209-215, 222-228; 235-242, 257-263, 270-280 and 209-247 of Seq ID No 235; 5-29, 31-38, 50-57, 62-75, 83-110, 115-132, 168-195, 197-206, 216-242, 249-258, 262-269, 333-340, 342-350, 363-368, 376-392, 400-406, 410-421, 423-430, 436-442, 448-454, 460-466, 471-476, 491-496, 511-516, 531-536, 551-556, 571-576, 585-591, 599-605, 27-70, 219-293, 441-504 and 512-584 of Seq ID No 236; 4-12, 14-34, 47-75, 83-104, 107-115, 133-140, 148-185, 187-196, 207-212, 224-256, 258-265, 281-287, 289-296, 298-308, 325-333, 345-355, 365-371, 382-395, 424-435, 441-457, 465-472, 483-491, 493-505, 528-534, 536-546, 552-558, 575-584, 589-600, 616-623 and 576-591 of Seq ID No 237; 4-76, 78-89, 91-126, 142-148, 151-191, 195-208, 211-223, 226-240, 256-277, 279-285, 290-314, 317-323, 358-377, 381-387, 391-396, 398-411, 415-434, 436-446, 454-484, 494-512, 516-523, 538-552, 559-566, 571-577, 579-596, 599-615, 620-627, 635-644, 694-707, 720-734, 737-759, 761-771 and 313-329 of Seq ID No 238; 7-38, 44-49, 79-89, 99-108, 117-123, 125-132, 137-146, 178-187, 207-237, 245-255, 322-337, 365-387, 398-408, 445-462, 603-608, 623-628, 644-650, 657-671, 673-679 and 111-566 of Seq ID No 239; 6-20, 22-35, 39-45, 58-64, 77-117, 137-144, 158-163, 205-210, 218-224, 229-236, 239-251, 263-277, 299-307, 323-334, 353-384, 388-396, 399-438, 443-448, 458-463, 467-478, 481-495, 503-509, 511-526, 559-576, 595-600, 612-645, 711-721, 723-738, 744-758, 778-807 and 686-720 of Seq ID No 240; 10-33, 35-41, 72-84, 129-138, 158-163, 203-226, 243-252, 258-264, 279-302, 322-329, 381-386, 401-406, 414-435 and 184-385 of Seq ID No 241; 4-9, 19-24, 41-47, 75-85, 105-110, 113-146 and 45-62 of Seq ID No 242; 4-25, 52-67, 117-124, 131-146, 173-180, 182-191, 195-206, 215-221, 229-236, 245-252, 258-279, 286-291, 293-302, 314-320, 327-336, 341-353, 355-361, 383-389 and 1-285 of Seq ID No 243; 14-32, 38-50, 73-84, 93-105, 109-114 and 40-70 of Seq ID No 244; 5-26 and 22-34 of Seq ID No 245; 23-28 and 13-39 of Seq ID No 246; 8-14 and 21-34 of Seq ID No 247; 4-13, 20-29, 44-50, 59-74 and 41-69 of Seq ID No 248; 4-9, 19-42, 48-59, 71-83 and 57-91 of Seq ID No 249; 4-14 and 10-28 of Seq ID No 250; 22-28, 32-42, 63-71, 81-111, 149-156, 158-167, 172-180, 182-203, 219-229 and 27-49 of Seq ID No 251; 17-27 and 23-32 of Seq ID No 252; 18-24 and 28-38 of Seq ID No 253; 9-15 and 13-27 of Seq ID No 254; 13-22 and 18-29 of Seq ID No 255; 17-26 and 2-11 of Seq ID No 256; 4-33 and 16-32 of Seq ID No 257; 4-10, 37-43, 54-84, 92-127 and 15-62 of Seq ID No 258; 4-14, 20-32, 35-60, 69-75, 79-99, 101-109, 116-140 and 124-136 of Seq ID No 259; 2-13 of Seq ID No 260; 4-13, 28-42 and 42-57 of Seq ID No 261; 4-14, 27-44 and 14-35 of Seq ID No 262; 4-12 and 1-27 of Seq ID No 263; 4-18, 39-45, 47-74 and 35-66 of Seq ID No 264; 8-20, 43-77 and 17-36 of Seq ID No 265; 4-30, 35-45, 51-57 and 35-49 of Seq ID No 266; 4-24, 49-57 and 15-34 of Seq ID No 267; 4-22 and 8-27 of Seq ID No 268; 13-25, 32-59, 66-80 and 21-55 of Seq ID No 269; 4-10, 24-33, 35-42, 54-65, 72-82, 98-108 and 15-30 of Seq ID No 270; 8-19 and 17-47 of Seq ID No 271; 12-18, 40-46 and 31-52 of Seq ID No 272; 4-20, 35-78, 83-102, 109-122 and 74-86 of Seq ID No 273; 7-17, 21-41, 46-63 and 2-20 of Seq ID No 274; 30-37 and 2-33 of Seq ID No 275; 4-13, 17-25 and 1-15 of Seq ID No 276; 17-31, 44-51 and 20-51 of Seq ID No 277; 20-30 and 5-23 of Seq ID No 278; 13-33, 48-71 and 92-110 of Seq ID No 279; 4-9, 50-69, 76-88, 96-106, 113-118 and 12-34 of Seq ID No 280; 4-24 and 6-26 of Seq ID No 281; 7-26 and 14-30 of Seq ID No 282; 9-39, 46-68, 75-82, 84-103 and 26-44 of Seq ID No 283; 4-30, 33-107 and 58-84 of Seq ID No 284; 4-12 and 9-51 of Seq ID No 285; 12-18, 29-37 and 6-37 of Seq ID No 286; 4-21, 33-52, 64-71 and 16-37 of Seq ID No 287; 9-19 and 2-30 of Seq ID No 288; 20-37 of Seq ID No 245; 8-27 of Seq ID No 246; 10-27 of Seq ID No 247; 42-59 and 52-69 of Seq ID No 248; 63-80 and 74-91 of Seq ID No 249; 11-28 of Seq ID No 250; 28-49 of Seq ID No 251; 15-32 of Seq ID No 252; 4-20 of Seq ID No 253; 10-27 of Seq ID No 254; 17-34 of Seq ID No 255; 1-18 of Seq ID No 256; 16-33 of Seq ID No 257; 16-36, 30-49 and 43-62 of Seq ID No 258; 122-139 of Seq ID No 259; 1-18 of Seq ID No 260; 41-58 of Seq ID No 261; 15-35 of Seq ID No 262; 2-27 of Seq ID No 263; 18-36 of Seq ID No 265; 34-51 of Seq ID No 266; 9-27 of Seq ID No 268; 22-47 of Seq ID No 269; 18-36 and 29-47 of Seq ID No 271; 32-52 of Seq ID No 272; 72-89 of Seq ID No 273; 3-20 of Seq ID No 274; 3-21 and 15-33 of Seq ID No 275; 1-18 of Seq ID No 276; 6-23 of Seq ID No 278; 93-110 of Seq ID No 279; 13-34 of Seq ID No 280; 7-26 and 9-26 of Seq ID No 281; 16-33 of Seq ID No 282; 27-44 of Seq ID No 283; 67-84 of Seq ID No 284; 10-33 and 26-50 of Seq ID No 285; 7-25 and 19-37 of Seq ID No 286; 17-37 of Seq ID No 287; 3-20 and 13-30 of Seq ID No 288; 62-80 and 75-93 of Seq ID No 145; 92-108 of Seq ID No 147; 332-349, 177-200 and 1755-1777 of Seq ID No 148; 109-133, 149-174, 260-285 and 460-485 of Seq ID No 149; 26-47 and 42-64 of Seq ID No 150; 22-41, 35-54, 115-130, 306-325, 401-420 and 454-478 of Seq ID No 151; 22-45 of Seq ID No 155; 156-174, 924-940, 1485-1496, 1447-1462 and 1483-1498 of Seq ID No 160; 457-475 of Seq ID No 161; 302-325 of Seq ID No 163; 288-305 of Seq ID No 164; 244-266 and 260-282 of Seq ID No 165; 204-225 and 220-241 of Seq ID No 166; 324-345, 340-361, 356-377, 372-393 and 388-408 of Seq ID No 167; 39-64 of Seq ID No 168; 54-76 and 70-92 of Seq ID No 169; 1227-1247, 1539-1559, 1554-1574, 1569-1589, 1584-1604, 1242-1262, 1272-1292, 1287-1308, 1456-1477, 1472-1494, 1488-1510 and 1505-1526 of Seq ID No 170; 351-368 of Seq ID No 172; 179-200, 195-216, 211-232, 227-248 and 243-263 of Seq ID No 173; 13-37 of Seq ID No 174; 208-224 of Seq ID No 175; 42-64, 59-81, 304-328, 323-348, 465-489, 968-992, 1399-1418, 1412-1431 and 2092-2111 of Seq ID No 177; 1528-1547 and 1541-1560 of Seq ID No 178; 184-200, 367-388, 382-403, 409-429, 425-444 and 438-457 of Seq ID No 179; 27-50 and 45-67 of Seq ID No 180; 114-131 and 405-419 of Seq ID No 183; 113-134, 129-150, 145-166, 161-182 and 177-198 of Seq ID No 184; 495-515 of Seq ID No 186; 346-358 of Seq ID No 187; 208-224 of Seq ID No 190; 178-194, 202-223, 217-238, 288-308 and 1355-1372 of Seq ID No 192; 57-78 of Seq ID No 194; 347-369, 364-386, 381-403, 398-420, 415-437 and 432-452 of Seq ID No 197; 347-372 of Seq ID No 198; 147-163 of Seq ID No 199; 263-288 of Seq ID No 200; 361-377 of Seq ID No 202; 82-104, 99-121, 116-138, 133-155 and 150-171 of Seq ID No 204; 110-130 and 125-145 of Seq ID No 205; 613-631, 626-644 and 196-213 of Seq ID No 206; 78-100, 95-117, 112-134 and 129-151 of Seq ID No 208; 158-180, 175-197, 192-214, 209-231 and 226-248 of Seq ID No 209; 30-50, 45-65 and 60-79 of Seq ID No 210; 431-455 and 450-474 of Seq ID No 213; 579-601, 596-618, 613-635 and 630-653 of Seq ID No 214; 920-927, 98-119, 114-135, 130-151, 146-167 and 162-182 of Seq ID No 217; 36-59 of Seq ID No 219; 194-216 and 381-404 of Seq ID No 220; 236-251 and 255-279 of Seq ID No 221; 80-100 and 141-164 of Seq ID No 222; 128-154 of Seq ID No 223; 82-100, 95-116 and 111-134 of Seq ID No 224; 55-76, 71-92 and 87-110 of Seq ID No 227; 91-106 of Seq ID No 229; 74-96 of Seq ID No 230; 140-157 of Seq ID No 231; 4-13 of Seq ID No 233; 41-65 and 499-523 of Seq ID No 236; 122-146, 191-215, 288-313, 445-469 and 511-535 of Seq ID No 239; 347-368 of Seq ID No 241; 46-61 of Seq ID No 242; 15-37, 32-57, 101-121, 115-135, 138-158, 152-172, 220-242 and 236-258 of Seq ID No 243, and fragments comprising at least 6, preferably more than 8, especially more than 10 aa and preferably not more than 70, 50, 40, 20, 15, 11 aa of said sequences. All these fragments individually and each independently form a preferred selected aspect of the present invention.

All linear hyperimmune serum reactive fragments of a particular antigen may be identified by analysing the entire sequence of the protein antigen by a set of peptides overlapping by 1 amino acid with a length of at least 10 amino acids. Subsequently, non-linear epitopes can be identified by analysis of the protein antigen with hyperimmune sera using the expressed full-length protein or domain polypeptides thereof. Assuming that a distinct domain of a protein is sufficient to form the 3D structure independent from the native protein, the analysis of the respective recombinant or synthetically produced domain polypeptide with hyperimmune serum would allow the identification of conformational epitopes within the individual domains of multi-domain proteins. For those antigens where a domain possesses linear as well as conformational epitopes, competition experiments with peptides corresponding to the linear epitopes may be used to confirm the presence of conformational epitopes.

It will be appreciated that the invention also relates to, among others, nucleic acid molecules encoding the aforementioned fragments, nucleic acid molecules that hybridise to nucleic acid molecules encoding the fragments, particularly those that hybridise under stringent conditions, and nucleic acid molecules, such as PCR primers, for amplifying nucleic acid molecules that encode the fragments. In these regards, preferred nucleic acid molecules are those that correspond to the preferred fragments, as discussed above.

The present invention also relates to vectors, which comprise a nucleic acid molecule or nucleic acid molecules of the present invention, host cells which are genetically engineered with vectors of the invention and the production of hyperimmune serum reactive antigens and fragments thereof by recombinant techniques.

A great variety of expression vectors can be used to express a hyperimmune serum reactive antigen or fragment thereof according to the present invention. Generally, any vector suitable to maintain, propagate or express nucleic acids to express a polypeptide in a host may be used for expression in this regard. In accordance with this aspect of the invention the vector may be, for example, a plasmid vector, a single or double-stranded phage vector, a single or double-stranded RNA or DNA viral vector. Starting plasmids disclosed herein are either commercially available, publicly available, or can be constructed from available plasmids by routine application of well-known, published procedures. Preferred among vectors, in certain respects, are those for expression of nucleic acid molecules and hyperimmune serum reactive antigens or fragments thereof of the present invention. Nucleic acid constructs in host cells can be used in a conventional manner to produce the gene product encoded by the recombinant sequence. Alternatively, the hyperimmune serum reactive antigens and fragments thereof of the invention can be synthetically produced by conventional peptide synthesizers. Mature proteins can be expressed in mammalian cells, yeast, bacteria, or other cells under the control of appropriate promoters. Cell-free translation systems can also be employed to produce such proteins using RNAs derived from the DNA construct of the present invention.

Host cells can be genetically engineered to incorporate nucleic acid molecules and express nucleic acid molecules of the present invention. Representative examples of appropriate hosts include bacterial cells, such as streptococci, staphylococci, *E. coli, Streptomyces* and *Bacillus subtillis* cells; fungal cells, such as yeast cells and *Aspergillus* cells; insect cells such as Drosophila S2 and Spodoptera SD cells; animal cells such as CHO, COS, Hela, C127, 3T3, BHK, 293 and Bowes melanoma cells; and plant cells.

The invention also provides a process for producing a *S. pneumoniae* hyperimmune serum reactive antigen and a fragment thereof comprising expressing from the host cell a hyperimmune serum reactive antigen or fragment thereof encoded by the nucleic acid molecules provided by the present invention. The invention further provides a process for producing a cell, which expresses a *S. pneumoniae* hyperimmune serum reactive antigen or a fragment thereof comprising transforming or transfecting a suitable host cell with the vector according to the present invention such that the transformed or transfected cell expresses the polypeptide encoded by the nucleic acid contained in the vector.

The polypeptide may be expressed in a modified form, such as a fusion protein, and may include not only secretion signals but also additional heterologous functional regions. Thus, for instance, a region of additional amino acids, particularly charged amino acids, may be added to the N- or C-terminus of the polypeptide to improve stability and persistence in the host cell, during purification or during subsequent handling and storage. Also, regions may be added to the polypeptide to facilitate purification. Such regions may be removed prior to final preparation of the polypeptide. The addition of peptide moieties to polypeptides to engender secretion or excretion, to improve stability or to facilitate purification, among others, are familiar and routine techniques in the art. A preferred fusion protein comprises a heterologous region from immunoglobulin that is useful to solubilize or purify polypeptides. For example, EP-A-O 464 533 (Canadian counterpart 2045869) discloses fusion proteins comprising various portions of constant region of immunoglobin molecules together with another protein or part thereof In drug discovery, for example, proteins have been fused with antibody Fc portions for the purpose of highthroughout screening assays to identify antagonists. See for example, {Bennett, D. et al., 1995} and {Johanson, K. et al., 1995}.

The *S. pneumoniae* hyperimmune serum reactive antigen or a fragment thereof can be recovered and purified from recombinant cell cultures by well-known methods including ammonium sulfate or ethanol precipitation, acid extraction, anion or cation exchange chromatography, phosphocellulose chromatography, hydrophobic interaction chromatography, hydroxylapatite chromatography and lectin chromatography.

The hyperimmune serum reactive antigens and fragments thereof according to the present invention can be produced by chemical synthesis as well as by biotechnological means. The latter comprise the transfection or transformation of a host cell with a vector containing a nucleic acid according to the present invention and the cultivation of the transfected or transformed host cell under conditions, which are known to the ones skilled in the art. The production method may also comprise a purification step in order to purify or isolate the polypeptide to be manufactured. In a preferred embodiment the vector is a vector according to the present invention.

The hyperimmune serum reactive antigens and fragments thereof according to the present invention may be used for the detection of the organism or organisms in a sample containing these organisms or polypeptides derived thereof. Preferably such detection is for diagnosis, more preferable for the diagnosis of a disease, most preferably for the diagnosis of a diseases related or linked to the presence or abundance of Gram-positive bacteria, especially bacteria selected from the group comprising streptococci, staphylococci and lactococci. More preferably, the microorganisms are selected from the group comprising *Streptococcus agalactiae, Streptococcus pyogenes* and *Streptococcus mutans*, especially the microorganism is *Streptococcus pyogenes*.

The present invention also relates to diagnostic assays such as quantitative and diagnostic assays for detecting levels of the hyperimmune serum reactive antigens and fragments thereof of the present invention in cells and tissues, including determination of normal and abnormal levels. Thus, for instance, a diagnostic assay in accordance with the invention for detecting over-expression of the polypeptide compared to normal control tissue samples may be used to detect the presence of an infection, for example, and to identify the infecting organism. Assay techniques that can be used to determine levels of a polypeptide, in a sample derived from a host are well known to those of skill in the art. Such assay methods include radioimmunoassays, competitive-binding assays, Western Blot analysis and ELISA assays. Among these, ELISAs frequently are preferred. An ELISA assay initially comprises preparing an antibody specific to the polypeptide, preferably a monoclonal antibody. In addition, a reporter antibody generally is prepared which binds to the monoclonal antibody. The reporter antibody is attached to a detectable reagent such as radioactive, fluorescent or enzymatic reagent, such as horseradish peroxidase enzyme.

The hyperimmune serum reactive antigens and fragments thereof according to the present invention may also be used for the purpose of or in connection with an array. More particularly, at least one of the hyperimmune serum reactive antigens and fragments thereof according to the present invention may be immobilized on a support. Said support typically comprises a variety of hyperimmune serum reactive antigens and fragments thereof whereby the variety may be created by using one or several of the hyperimmune serum reactive antigens and fragments thereof according to the present invention and/or hyperimmune serum reactive antigens and fragments thereof being different. The characterizing feature of such array as well as of any array in general is the fact that at a distinct or predefined region or position on said support or a surface thereof, a distinct polypeptide is immobilized. Because of this any activity at a distinct position or region of an array can be correlated with a specific polypeptide. The number of different hyperimmune serum reactive antigens and fragments thereof immobilized on a support may range from as little as 10 to several 1000 different hyperimmune serum reactive antigens and fragments thereof The density of hyperimmune serum reactive antigens and fragments thereof per $cm^2$ is in a preferred embodiment as little as 10 peptides/polypeptides per $cm^2$ to at least 400 different peptides/polypeptides per $cm^2$ and more particularly at least 1000 different hyperimmune serum reactive antigens and fragments thereof per $cm^2$.

The manufacture of such arrays is known to the one skilled in the art and, for example, described in U.S. Pat. No. 5,744, 309. The array preferably comprises a planar, porous or non-porous solid support having at least a first surface. The hyperimmune serum reactive antigens and fragments thereof as disclosed herein, are immobilized on said surface. Preferred support materials are, among others, glass or cellulose. It is also within the present invention that the array is used for any of the diagnostic applications described herein. Apart from the hyperimmune serum reactive antigens and fragments thereof according to the present invention also the nucleic acid molecules according to the present invention may be used for the generation of an array as described above. This applies as well to an array made of antibodies, preferably monoclonal antibodies as, among others, described herein.

In a further aspect the present invention relates to an antibody directed to any of the hyperimmune serum reactive antigens and fragments thereof, derivatives or fragments thereof according to the present invention. The present invention includes, for example, monoclonal and polyclonal antibodies, chimeric, single chain, and humanized antibodies, as well as Fab fragments, or the product of a Fab expression library. It is within the present invention that the antibody may be chimeric, i.e. that different parts thereof stem from different species or at least the respective sequences are taken from different species.

Antibodies generated against the hyperimmune serum reactive antigens and fragments thereof corresponding to a sequence of the present invention can be obtained by direct injection of the hyperimmune serum reactive antigens and fragments thereof into an animal or by administering the hyperimmune serum reactive antigens and fragments thereof to an animal, preferably a non-human. The antibody so obtained will then bind the hyperimmune serum reactive antigens and fragments thereof itself In this manner, even a sequence encoding only a fragment of a hyperimmune serum reactive antigen and fragments thereof can be used to generate antibodies binding the whole native hyperimmune serum reactive antigen and fragments thereof. Such antibodies can then be used to isolate the hyperimmune serum reactive antigens and fragments thereof from tissue expressing those hyperimmune serum reactive antigens and fragments thereof.

For preparation of monoclonal antibodies, any technique known in the art, which provides antibodies produced by continuous cell line cultures can be used (as described originally in {Kohler, G. et al., 1975}.

Techniques described for the production of single chain antibodies (U.S. Pat. No. 4,946,778) can be adapted to produce single chain antibodies to immunogenic hyperimmune serum reactive antigens and fragments thereof according to this invention. Also, transgenic mice, or other organisms such as other mammals, may be used to express humanized antibodies to immunogenic hyperimmune serum reactive antigens and fragments thereof according to this invention.

Alternatively, phage display technology or ribosomal display could be utilized to select antibody genes with binding activities towards the hyperimmune serum reactive antigens and fragments thereof either from repertoires of PCR amplified v-genes of lymphocytes from humans screened for possessing respective target antigens or from naïve libraries {McCafferty, J. et al., 1990}; {Marks, J. et al., 1992}. The affinity of these antibodies can also be improved by chain shuffling {Clackson, T. et al., 1991}.

If two antigen binding domains are present, each domain may be directed against a different epitope—termed 'bispecific' antibodies.

The above-described antibodies may be employed to isolate or to identify clones expressing the hyperimmune serum reactive antigens and fragments thereof or purify the hyperimmune serum reactive antigens and fragments thereof of the present invention by attachment of the antibody to a solid support for isolation and/or purification by affinity chromatography.

Thus, among others, antibodies against the hyperimmune serum reactive antigens and fragments thereof of the present invention may be employed to inhibit and/or treat infections, particularly bacterial infections and especially infections arising from *S. pneumoniae.*

Hyperimmune serum reactive antigens and fragments thereof include antigenically, epitopically or immunologically equivalent derivatives, which form a particular aspect of this invention. The term "antigenically equivalent derivative" as used herein encompasses a hyperimmune serum reactive antigen and fragments thereof or its equivalent which will be specifically recognized by certain antibodies which, when raised to the protein or hyperimmune serum reactive antigen and fragments thereof according to the present invention, interfere with the interaction between pathogen and mammalian host. The term "immunologically equivalent derivative" as used herein encompasses a peptide or its equivalent which when used in a suitable formulation to raise antibodies in a vertebrate, the antibodies act to interfere with the interaction between pathogen and mammalian host.

The hyperimmune serum reactive antigens and fragments thereof, such as an antigenically or immunologically equivalent derivative or a fusion protein thereof can be used as an antigen to immunize a mouse or other animal such as a rat or chicken. The fusion protein may provide stability to the hyperimmune serum reactive antigens and fragments thereof. The antigen may be associated, for example by conjugation, with an immunogenic carrier protein, for example bovine serum albumin (BSA) or keyhole limpet haemocyanin (KLH). Alternatively, an antigenic peptide comprising multiple copies of the protein or hyperimmune serum reactive antigen and fragments thereof, or an antigenically or immunologically equivalent hyperimmune serum reactive antigen and fragments thereof, may be sufficiently antigenic to improve immunogenicity so as to obviate the use of a carrier.

Preferably the antibody or derivative thereof is modified to make it less immunogenic in the individual. For example, if the individual is human the antibody may most preferably be "humanized", wherein the complimentarity determining region(s) of the hybridoma-derived antibody has been transplanted into a human monoclonal antibody, for example as described in {Jones, P. et al., 1986} or {Tempest, P. et al., 1991}.

The use of a polynucleotide of the invention in genetic immunization will preferably employ a suitable delivery method such as direct injection of plasmid DNA into muscle, delivery of DNA complexed with specific protein carriers, coprecipitation of DNA with calcium phosphate, encapsulation of DNA in various forms of liposomes, particle bombardment {Tang, D. et al., 1992}; {Eisenbraun, M. et al., 1993} and in vivo infection using cloned retroviral {Seeger, C. et al., 1984}.

In a further aspect the present invention relates to a peptide binding to any of the hyperimmune serum reactive antigens and fragments thereof according to the present invention, and a method for the manufacture of such peptides whereby the method is characterized by the use of the hyperimmune serum reactive antigens and fragments thereof according to the present invention and the basic steps are known to the one skilled in the art.

Such peptides may be generated by using methods according to the state of the art such as phage display or ribosome display. In case of phage display, basically a library of peptides is generated, in form of phages, and this kind of library is contacted with the target molecule, in the present case a hyperimmune serum reactive antigen and fragments thereof according to the present invention. Those peptides binding to the target molecule are subsequently removed, preferably as a complex with the target molecule, from the respective reaction. It is known to the one skilled in the art that the binding characteristics, at least to a certain extent, depend on the particularly realized experimental set-up such as the salt concentration and the like. After separating those peptides binding to the target molecule with a higher affinity or a bigger force, from the non-binding members of the library, and optionally also after removal of the target molecule from the complex of target molecule and peptide, the respective peptide(s) may subsequently be characterised. Prior to the characterisation optionally an amplification step is realized such as, e.g. by propagating the peptide encoding phages. The characterisation preferably comprises the sequencing of the target binding peptides. Basically, the peptides are not limited in their lengths, however, preferably peptides having a lengths from about 8 to 20 amino acids are preferably obtained in the respective methods. The size of the libraries may be about $10^2$ to $10^{18}$, preferably $10^8$ to $10^{15}$ different peptides, however, is not limited thereto.

A particular form of target binding hyperimmune serum reactive antigens and fragments thereof are the so-called "anticalines" which are, among others, described in German patent application DE 197 42 706.

In a further aspect the present invention relates to functional nucleic acids interacting with any of the hyperimmune serum reactive antigens and fragments thereof according to the present invention, and a method for the manufacture of such functional nucleic acids whereby the method is characterized by the use of the hyperimmune serum reactive antigens and fragments thereof according to the present invention and the basic steps are known to the one skilled in the art. The functional nucleic acids are preferably aptamers and spiegelmers.

Aptamers are D-nucleic acids, which are either single stranded or double stranded and which specifically interact with a target molecule. The manufacture or selection of aptamers is, e.g. described in European patent EP 0 533 838. Basically the following steps are realized. First, a mixture of nucleic acids, i.e. potential aptamers, is provided whereby each nucleic acid typically comprises a segment of several, preferably at least eight subsequent randomised nucleotides. This mixture is subsequently contacted with the target molecule whereby the nucleic acid(s) bind to the target molecule, such as based on an increased affinity towards the target or with a bigger force thereto, compared to the candidate mixture. The binding nucleic acid(s) are/is subsequently separated from the remainder of the mixture. Optionally, the thus obtained nucleic acid(s) is amplified using, e.g. polymerase chain reaction. These steps may be repeated several times giving at the end a mixture having an increased ratio of nucleic acids specifically binding to the target from which the final binding nucleic acid is then optionally selected. These specifically binding nucleic acid(s) are referred to as aptamers. It is obvious that at any stage of the method for the generation or identification of the aptamers samples of the mixture of individual nucleic acids may be taken to determine the sequence thereof using standard techniques. It is within the present invention that the aptamers may be stabilized such as, e.g., by introducing defined chemical groups which are known to the one skilled in the art of generating aptamers. Such modification may for example reside in the introduction of an amino group at the 2'-position of the sugar moiety of the nucleotides. Aptamers are currently used as therapeutical agents. However, it is also within the present invention that the thus selected or generated aptamers may be used for target validation and/or as lead substance for the development of medicaments, preferably of medicaments based on small molecules. This is actually done by a competition assay whereby the specific interaction between the target molecule and the aptamer is inhibited by a candidate drug whereby upon replacement of the aptamer from the complex of target and aptamer it may be assumed that the respective drug candidate allows a specific inhibition of the interaction between target and aptamer, and if the interaction is specific, said candidate drug will, at least in principle, be suitable to block the target and thus decrease its biological availability or activity in a respective system comprising such target. The thus obtained small molecule may then be subject to further derivatisation and modification to optimise its physical, chemical, biological and/or medical characteristics such as toxicity, specificity, biodegradability and bioavailability.

Spiegelmers and their generation or manufacture is based on a similar principle. The manufacture of spiegelmers is described in international patent application WO 98/08856. Spiegelmers are L-nucleic acids, which means that they are composed of L-nucleotides rather than D-nucleotides as aptamers are. Spiegelmers are characterized by the fact that they have a very high stability in biological systems and, comparable to aptamers, specifically interact with the target molecule against which they are directed. In the process of generating spiegelmers, a heterogeonous population of D-nucleic acids is created and this population is contacted with the optical antipode of the target molecule, in the present case for example with the D-enantiomer of the naturally occurring L-enantiomer of the hyperimmune serum reactive antigens and fragments thereof according to the present invention. Subsequently, those D-nucleic acids are separated which do not interact with the optical antipode of the target molecule. But those D-nucleic acids interacting with the optical antipode of the target molecule are separated, optionally identified and/or sequenced and subsequently the corresponding L-nucleic acids are synthesized based on the nucleic acid sequence information obtained from the D-nucleic acids. These L-nucleic acids which are identical in terms of sequence with the aforementioned D-nucleic acids interacting with the optical antipode of the target molecule, will specifically interact with the naturally occurring target molecule rather than with the optical antipode thereof. Similar to the method for the generation of aptamers it is also possible to repeat the various steps several times and thus to enrich those nucleic acids specifically interacting with the optical antipode of the target molecule.

In a further aspect the present invention relates to functional nucleic acids interacting with any of the nucleic acid molecules according to the present invention, and a method for the manufacture of such functional nucleic acids whereby the method is characterized by the use of the nucleic acid molecules and their respective sequences according to the present invention and the basic steps are known to the one skilled in the art. The functional nucleic acids are preferably ribozymes, antisense oligonucleotides and siRNA.

Ribozymes are catalytically active nucleic acids which preferably consist of RNA which basically comprises two moieties. The first moiety shows a catalytic activity whereas the second moiety is responsible for the specific interaction with the target nucleic acid, in the present case the nucleic acid coding for the hyperimmune serum reactive antigens and fragments thereof according to the present invention. Upon interaction between the target nucleic acid and the second moiety of the ribozyme, typically by hybridisation and Watson-Crick base pairing of essentially complementary stretches of bases on the two hybridising strands, the catalytically active moiety may become active which means that it catalyses, either intramolecularly or intermolecularly, the target nucleic acid in case the catalytic activity of the ribozyme is a phosphodiesterase activity. Subsequently, there may be a further degradation of the target nucleic acid, which in the end results in the degradation of the target nucleic acid as well as the protein derived from the said target nucleic acid. Ribozymes, their use and design principles are known to the one skilled in the art, and, for example described in {Doherty, E. et al., 2001} and {Lewin, A. et al., 2001}.

The activity and design of antisense oligonucleotides for the manufacture of a medicament and as a diagnostic agent, respectively, is based on a similar mode of action. Basically, antisense oligonucleotides hybridise based on base complementarity, with a target RNA, preferably with a mRNA, thereby activating RNase H. RNase H is activated by both phosphodiester and phosphorothioate-coupled DNA. Phosphodiester-coupled DNA, however, is rapidly degraded by cellular nucleases with the exception of phosphorothioate-coupled DNA. These resistant, non-naturally occurring DNA derivatives do not inhibit RNase H upon hybridisation with RNA. In other words, antisense polynucleotides are only effective as DNA RNA hybrid complexes. Examples for this kind of antisense oligonucleotides are described, among others, in U.S. Pat. No. 5,849,902 and U.S. Pat. No. 5,989,912. In other words, based on the nucleic acid sequence of the target molecule which in the present case are the nucleic acid molecules for the hyperimmune serum reactive antigens and fragments thereof according to the present invention, either from the target protein from which a respective nucleic acid sequence may in principle be deduced, or by knowing the nucleic acid sequence as such, particularly the mRNA, suitable antisense oligonucleotides may be designed base on the principle of base complementarity.

Particularly preferred are antisense-oligonucleotides, which have a short stretch of phosphorothioate DNA (3 to 9 bases). A minimum of 3 DNA bases is required for activation of bacterial RNase H and a minimum of 5 bases is required for mammalian RNase H activation. In these chimeric oligonucleotides there is a central region that forms a substrate for RNase H that is flanked by hybridising "arms" comprised of modified nucleotides that do not form substrates for RNase H. The hybridising arms of the chimeric oligonucleotides may be modified such as by 2'-O-methyl or 2'-fluoro. Alternative approaches used methylphosphonate or phosphoramidate linkages in said arms. Further embodiments of the antisense oligonucleotide useful in the practice of the present invention are P-methoxyoligonucleotides, partial P-methoxyoligodeoxyribonucleotides or P-methoxyoligonucleotides.

Of particular relevance and usefulness for the present invention are those antisense oligonucleotides as more particularly described in the above two mentioned US patents. These oligonucleotides contain no naturally occurring 5'→3'-linked nucleotides. Rather the oligonucleotides have two types of nucleotides: 2'-deoxyphosphorothioate, which activate RNase H, and 2'-modified nucleotides, which do not. The linkages between the 2'-modified nucleotides can be phosphodiesters, phosphorothioate or P-ethoxyphosphodiester. Activation of RNase H is accomplished by a contiguous RNase H-activating region, which contains between 3 and 5 2'-deoxyphosphorothioate nucleotides to activate bacterial RNase H and between 5 and 10 2'-deoxyphosphorothioate nucleotides to activate eucaryotic and, particularly, mammalian RNase H. Protection from degradation is accomplished by making the 5' and 3' terminal bases highly nuclease resistant and, optionally, by placing a 3' terminal blocking group.

More particularly, the antisense oligonucleotide comprises a 5' terminus and a 3' terminus; and from position 11 to 59 5→3'-linked nucleotides independently selected from the group consisting of 2'-modified phosphodiester nucleotides and 2'-modified P-alkyloxyphosphotriester nucleotides; and wherein the 5'-terminal nucleoside is attached to an RNase H-activating region of between three and ten contiguous phosphorothioate-linked deoxyribonucleotides, and wherein the 3'-terminus of said oligonucleotide is selected from the group consisting of an inverted deoxyribonucleotide, a contiguous stretch of one to three phosphorothioate 2'-modified ribonucleotides, a biotin group and a P-alkyloxyphosphotriester nucleotide.

Also an antisense oligonucleotide may be used wherein not the 5' terminal nucleoside is attached to an RNase H-activating region but the 3' terminal nucleoside as specified above. Also, the 5' terminus is selected from the particular group rather than the 3' terminus of said oligonucleotide.

The nucleic acids as well as the hyperimmune serum reactive antigens and fragments thereof according to the present invention may be used as or for the manufacture of pharmaceutical compositions, especially vaccines. Preferably such pharmaceutical composition, preferably vaccine is for the prevention or treatment of diseases caused by, related to or associated with *S. pneumoniae*. In so far another aspect of the invention relates to a method for inducing an immunological response in an individual, particularly a mammal, which comprises inoculating the individual with the hyperimmune serum reactive antigens and fragments thereof of the invention, or a fragment or variant thereof, adequate to produce antibodies to protect said individual from infection, particularly streptococcal infection and most particularly *S. pneumoniae* infections.

Yet another aspect of the invention relates to a method of inducing an immunological response in an individual which comprises, through gene therapy or otherwise, delivering a nucleic acid functionally encoding hyperimmune serum reactive antigens and fragments thereof, or a fragment or a variant thereof, for expressing the hyperimmune serum reactive antigens and fragments thereof, or a fragment or a variant thereof in vivo in order to induce an immunological response to produce antibodies or a cell mediated T cell response, either cytokine-producing T cells or cytotoxic T cells, to protect said individual from disease, whether that disease is already established within the individual or not. One way of administering the gene is by accelerating it into the desired cells as a coating on particles or otherwise.

A further aspect of the invention relates to an immunological composition which, when introduced into a host capable of having induced within it an immunological response, induces an immunological response in such host, wherein the composition comprises recombinant DNA which codes for and expresses an antigen of the hyperimmune serum reactive antigens and fragments thereof of the present invention. The immunological response may be used therapeutically or prophylactically and may take the form of antibody immunity or cellular immunity such as that arising from CTL or CD4+ T cells.

The hyperimmune serum reactive antigens and fragments thereof of the invention or a fragment thereof may be fused with a co-protein which may not by itself produce antibodies, but is capable of stabilizing the first protein and producing a fused protein which will have immunogenic and protective properties. This fused recombinant protein preferably further comprises an antigenic co-protein, such as Glutathione-S-transferase (GST) or beta-galactosidase, relatively large co-proteins which solubilise the protein and facilitate production and purification thereof Moreover, the co-protein may act as an adjuvant in the sense of providing a generalized stimulation of the immune system. The co-protein may be attached to either the amino or carboxy terminus of the first protein.

Also, provided by this invention are methods using the described nucleic acid molecule or particular fragments thereof in such genetic immunization experiments in animal models of infection with *S. pneumoniae*. Such fragments will be particularly useful for identifying protein epitopes able to provoke a prophylactic or therapeutic immune response. This approach can allow for the subsequent preparation of monoclonal antibodies of particular value from the requisite organ of the animal successfully resisting or clearing infection for the development of prophylactic agents or therapeutic treatments of *S. pneumoniae* infection in mammals, particularly humans.

The hyperimmune serum reactive antigens and fragments thereof may be used as an antigen for vaccination of a host to produce specific antibodies which protect against invasion of bacteria, for example by blocking adherence of bacteria to damaged tissue. Examples of tissue damage include wounds in skin or connective tissue and mucosal tissues caused e.g. by viral infection (esp. respiratory, such as the flu) mechanical, chemical or thermal damage or by implantation of indwelling devices, or wounds in the mucous membranes, such as the mouth, mammary glands, urethra or vagina.

The present invention also includes a vaccine formulation, which comprises the immunogenic recombinant protein together with a suitable carrier. Since the protein may be broken down in the stomach, it is preferably administered parenterally, including, for example, administration that is subcutaneous, intramuscular, intravenous, intradermal intranasal or transdermal. Formulations suitable for parenteral administration include aqueous and non-aqueous sterile injection solutions which may contain anti-oxidants, buffers, bacteriostats and solutes which render the formulation isotonic with the bodily fluid, preferably the blood, of the individual; and aqueous and non-aqueous sterile suspensions which may include suspending agents or thickening agents. The formulations may be presented in unit-dose or multi-dose containers, for example, sealed ampoules and vials, and may be stored in a freeze-dried condition requiring only the addition of the sterile liquid carrier immediately prior to use. The vaccine formulation may also include adjuvant systems for enhancing the immunogenicity of the formulation, such as oil-in-water systems and other systems known in the art. The dosage will depend on the specific activity of the vaccine and can be readily determined by routine experimentation.

According to another aspect, the present invention relates to a pharmaceutical composition comprising such a hyperimmune serum-reactive antigen or a fragment thereof as provided in the present invention for *S. pneumoniae*. Such a pharmaceutical composition may comprise one, preferably at least two or more hyperimmune serum reactive antigens or fragments thereof against *S. pneumoniae*. Optionally, such *S. pneumoniae* hyperimmune serum reactive antigens or fragments thereof may also be combined with antigens against other pathogens in a combination pharmaceutical composition. Preferably, said pharmaceutical composition is a vaccine for preventing or treating an infection caused by *S. pneumoniae* and/or other pathogens against which the antigens have been included in the vaccine.

According to a further aspect, the present invention relates to a pharmaceutical composition comprising a nucleic acid molecule encoding a hyperimmune serum-reactive antigen or a fragment thereof as identified above for *S. pneumoniae*. Such a pharmaceutical composition may comprise one or more nucleic acid molecules encoding hyperimmune serum reactive antigens or fragments thereof against *S. pneumoniae*. Optionally, such *S. pneumoniae* nucleic acid molecules encoding hyperimmune serum reactive antigens or fragments thereof may also be combined with nucleic acid molecules encoding antigens against other pathogens in a combination pharmaceutical composition. Preferably, said pharmaceutical composition is a vaccine for preventing or treating an infection caused by *S. pneumoniae* and/or other pathogens against which the antigens have been included in the vaccine.

The pharmaceutical composition may contain any suitable auxiliary substances, such as buffer substances, stabilisers or further active ingredients, especially ingredients known in connection of pharmaceutical composition and/or vaccine production.

A preferable carrier/or excipient for the hyperimmune serum-reactive antigens, fragments thereof or a coding nucleic acid molecule thereof according to the present invention is an immunostimulatory compound for further stimulating the immune response to the given hyperimmune serum-reactive antigen, fragment thereof or a coding nucleic acid molecule thereof. Preferably the immunostimulatory compound in the pharmaceutical preparation according to the present invention is selected from the group of polycationic substances, especially polycationic peptides, immunostimulatory nucleic acids molecules, preferably immunostimulatory deoxynucleotides, alum, Freund's complete adjuvants, Freund's incomplete adjuvants, neuroactive compounds, especially human growth hormone, or combinations thereof.

It is also within the scope of the present invention that the pharmaceutical composition, especially vaccine, comprises apart from the hyperimmune serum reactive antigens, fragments thereof and/or coding nucleic acid molecules thereof according to the present invention other compounds which are biologically or pharmaceutically active. Preferably, the vaccine composition comprises at least one polycationic peptide. The polycationic compound(s) to be used according to the present invention may be any polycationic compound, which shows the characteristic effects according to the WO 97/30721. Preferred polycationic compounds are selected from basic polypeptides, organic polycations, basic polyamino acids or mixtures thereof. These polyamino acids should have a chain length of at least 4 amino acid residues (WO 97/30721). Especially preferred are substances like polylysine, polyarginine and polypeptides containing more than 20%, especially more than 50% of basic amino acids in a range of more than 8, especially more than 20, amino acid residues or mixtures thereof. Other preferred polycations and their pharmaceutical compositions are described in WO 97/30721 (e.g. polyethyleneimine) and WO 99/38528. Preferably these polypeptides contain between 20 and 500 amino acid residues, especially between 30 and 200 residues.

These polycationic compounds may be produced chemically or recombinantly or may be derived from natural sources.

Cationic (poly)peptides may also be anti-microbial with properties as reviewed in {Ganz, T., 1999}. These (poly) peptides may be of prokaryotic or animal or plant origin or may be produced chemically or recombinantly (WO 02/13857). Peptides may also belong to the class of defensins (WO 02/13857). Sequences of such peptides can be found, for example, in the Antimicrobial Sequences Database under the internet address: of the University of Trieste (bbcm.univ.trieste.it/~tossi/pag2.html).

Such host defence peptides or defensives are also a preferred form of the polycationic polymer according to the present invention. Generally, a compound allowing as an end product activation (or down-regulation) of the adaptive immune system, preferably mediated by APCs (including dendritic cells) is used as polycationic polymer.

Especially preferred for use as polycationic substances in the present invention are cathelicidin derived antimicrobial peptides or derivatives thereof (International patent application WO 02/13857, incorporated herein by reference), especially antimicrobial peptides derived from mammalian cathelicidin, preferably from human, bovine or mouse.

Polycationic compounds derived from natural sources include HIV-REV or HIV-TAT (derived cationic peptides, antennapedia peptides, chitosan or other derivatives of chitin) or other peptides derived from these peptides or proteins by biochemical or recombinant production. Other preferred polycationic compounds are cathelin or related or derived substances from cathelin. For example, mouse cathelin is a peptide which has the amino acid sequence NH2-RLAGLL-RKGGEKIGEKLKKIGQKIKNFFQKLVPQPE-COOH (SEQ ID NO: 319). Related or derived cathelin substances contain the whole or parts of the cathelin sequence with at least 15-20 amino acid residues. Derivations may include the substitution or modification of the natural amino acids by amino acids which are not among the 20 standard amino acids. Moreover, further cationic residues may be introduced into such cathelin molecules. These cathelin molecules are preferred to be combined with the antigen. These cathelin molecules surprisingly have turned out to be also effective as an adjuvant for an antigen without the addition of further adjuvants. It is therefore possible to use such cathelin molecules as efficient adjuvants in vaccine formulations with or without further immunoactivating substances.

Another preferred polycationic substance to be used according to the present invention is a synthetic peptide containing at least 2 KLK-motifs separated by a linker of 3 to 7 hydrophobic amino acids (International patent application WO 02/32451, incorporated herein by reference).

The pharmaceutical composition of the present invention may further comprise immunostimulatory nucleic acid(s). Immunostimulatory nucleic acids are e.g. neutral or artificial CpG containing nucleic acids, short stretches of nucleic acids derived from non-vertebrates or in form of short oligonucleotides (ODNs) containing non-methylated cytosine-guanine di-nucleotides (CpG) in a certain base context (e.g. described in WO 96/02555). Alternatively, also nucleic acids based on inosine and cytidine as e.g. described in the WO 01/93903, or deoxynucleic acids containing deoxy-inosine and/or deoxyuridine residues (described in WO 01/93905 and PCT/EP 02/05448, incorporated herein by reference) may preferably be used as immunostimulatory nucleic acids for the present invention. Preferably, the mixtures of different immunostimulatory nucleic acids may be used according to the present invention.

It is also within the present invention that any of the aforementioned polycationic compounds is combined with any of the immunostimulatory nucleic acids as aforementioned. Preferably, such combinations are according to the ones as described in WO 01/93905, WO 02/32451, WO 01/54720, WO 01/93903, WO 02/13857 and PCT/EP 02/05448 and the Austrian patent application A 1924/2001, incorporated herein by reference.

In addition or alternatively such vaccine composition may comprise apart from the hyperimmune serum reactive antigens and fragments thereof, and the coding nucleic acid molecules thereof according to the present invention a neuroactive compound. Preferably, the neuroactive compound is human growth factor as, e.g. described in WO 01/24822. Also preferably, the neuroactive compound is combined with any of the polycationic compounds and/or immunostimulatory nucleic acids as afore-mentioned.

In a further aspect the present invention is related to a pharmaceutical composition. Such pharmaceutical composition is, for example, the vaccine described herein. Also a pharmaceutical composition is a pharmaceutical composition which comprises any of the following compounds or combinations thereof: the nucleic acid molecules according to the present invention, the hyperimmune serum reactive antigens and fragments thereof according to the present invention, the vector according to the present invention, the cells according to the present invention, the antibody according to the present invention, the functional nucleic acids according to the present invention and the binding peptides such as the anticalines according to the present invention, any agonists and antagonists screened as described herein. In connection therewith any of these compounds may be employed in combination with a non-sterile or sterile carrier or carriers for use with cells, tissues or organisms, such as a pharmaceutical carrier suitable for administration to a subject. Such compositions comprise, for instance, a media additive or a therapeutically effective amount of a hyperimmune serum reactive antigen and fragments thereof of the invention and a pharmaceutically acceptable carrier or excipient. Such carriers may include, but are not limited to, saline, buffered saline, dextrose, water, glycerol, ethanol and combinations thereof The formulation should suit the mode of administration.

The pharmaceutical compositions may be administered in any effective, convenient manner including, for instance, administration by topical, oral, anal, vaginal, intravenous, intraperitoneal, intramuscular, subcutaneous, intranasal, intratracheal or intradermal routes among others.

In therapy or as a prophylactic, the active agent may be administered to an individual as an injectable composition, for example as a sterile aqueous dispersion, preferably isotonic.

Alternatively the composition may be formulated for topical application, for example in the form of ointments, creams, lotions, eye ointments, eye drops, ear drops, mouthwash, impregnated dressings and sutures and aerosols, and may contain appropriate conventional additives, including, for example, preservatives, solvents to assist drug penetration, and emollients in ointments and creams. Such topical formulations may also contain compatible conventional carriers, for example cream or ointment bases, and ethanol or oleyl alcohol for lotions. Such carriers may constitute from about 1% to about 98% by weight of the formulation; more usually they will constitute up to about 80% by weight of the formulation.

In addition to the therapy described above, the compositions of this invention may be used generally as a wound treatment agent to prevent adhesion of bacteria to matrix proteins exposed in wound tissue and for prophylactic use in dental treatment as an alternative to, or in conjunction with, antibiotic prophylaxis.

A vaccine composition is conveniently in injectable form. Conventional adjuvants may be employed to enhance the immune response. A suitable unit dose for vaccination is 0.05-5 µg antigen/per kg of body weight, and such dose is preferably administered 1-3 times and with an interval of 1-3 weeks.

With the indicated dose range, no adverse toxicological effects should be observed with the compounds of the invention, which would preclude their administration to suitable individuals.

In a further embodiment the present invention relates to diagnostic and pharmaceutical packs and kits comprising one or more containers filled with one or more of the ingredients of the aforementioned compositions of the invention. The ingredient(s) can be present in a useful amount, dosage, formulation or combination. Associated with such container(s) can be a notice in the form prescribed by a governmental agency regulating the manufacture, use or sale of pharmaceuticals or biological products, reflecting approval by the agency of the manufacture, use or sale of the product for human administration.

In connection with the present invention any disease related use as disclosed herein such as, e.g. use of the pharmaceutical composition or vaccine, is particularly a disease or diseased condition which is caused by, linked or associated with Streptococci, more preferably, *S. pneumoniae*. In connection therewith it is to be noted that *S. pneumoniae* comprises several strains including those disclosed herein. A disease related, caused or associated with the bacterial infection to be prevented and/or treated according to the present invention includes besides others bacterial pharyngitis, otitis media, pneumonia, bacteremia, meningitis, peritonitis and sepsis in humans.

In a still further embodiment the present invention is related to a screening method using any of the hyperimmune serum reactive antigens or nucleic acids according to the present invention. Screening methods as such are known to the one skilled in the art and can be designed such that an agonist or an antagonist is screened. Preferably an antagonist is screened which in the present case inhibits or prevents the binding of any hyperimmune serum reactive antigen and fragment thereof according to the present invention to an interaction partner. Such interaction partner can be a naturally occurring interaction partner or a non-naturally occurring interaction partner.

The invention also provides a method of screening compounds to identify those, which enhance (agonist) or block (antagonist) the function of hyperimmune serum reactive antigens and fragments thereof or nucleic acid molecules of the present invention, such as its interaction with a binding molecule. The method of screening may involve high-throughput.

For example, to screen for agonists or antagonists, the interaction partner of the nucleic acid molecule and nucleic acid, respectively, according to the present invention, maybe a synthetic reaction mix, a cellular compartment, such as a membrane, cell envelope or cell wall, or a preparation of any thereof, may be prepared from a cell that expresses a molecule that binds to the hyperimmune serum reactive antigens and fragments thereof of the present invention. The preparation is incubated with labelled hyperimmune serum reactive antigens and fragments thereof in the absence or the presence of a candidate molecule, which may be an agonist or antagonist. The ability of the candidate molecule to bind the binding molecule is reflected in decreased binding of the labelled ligand. Molecules which bind gratuitously, i.e., without inducing the functional effects of the hyperimmune serum reactive antigens and fragments thereof, are most likely to be good antagonists. Molecules that bind well and elicit functional effects that are the same as or closely related to the hyperimmune serum reactive antigens and fragments thereof are good agonists.

The functional effects of potential agonists and antagonists may be measured, for instance, by determining the activity of a reporter system following interaction of the candidate molecule with a cell or appropriate cell preparation, and comparing the effect with that of the hyperimmune serum reactive antigens and fragments thereof of the present invention or molecules that elicit the same effects as the hyperimmune serum reactive antigens and fragments thereof. Reporter systems that may be useful in this regard include but are not limited to colorimetric labelled substrate converted into product, a reporter gene that is responsive to changes in the functional activity of the hyperimmune serum reactive antigens and fragments thereof, and binding assays known in the art.

Another example of an assay for antagonists is a competitive assay that combines the hyperimmune serum reactive antigens and fragments thereof of the present invention and a potential antagonist with membrane-bound binding molecules, recombinant binding molecules, natural substrates or ligands, or substrate or ligand mimetics, under appropriate conditions for a competitive inhibition assay. The hyperimmune serum reactive antigens and fragments thereof can be labelled such as by radioactivity or a colorimetric compound, such that the molecule number of hyperimmune serum reactive antigens and fragments thereof bound to a binding molecule or converted to product can be determined accurately to assess the effectiveness of the potential antagonist.

Potential antagonists include small organic molecules, peptides, polypeptides and antibodies that bind to a hyperimmune serum reactive antigen and fragments thereof of the invention and thereby inhibit or extinguish its activity. Potential antagonists also may be small organic molecules, a peptide, a polypeptide such as a closely related protein or antibody that binds to the same sites on a binding molecule without inducing functional activity of the hyperimmune serum reactive antigens and fragments thereof of the invention.

Potential antagonists include a small molecule, which binds to and occupies the binding site of the hyperimmune serum reactive antigens and fragments thereof thereby preventing binding to cellular binding molecules, such that normal biological activity is prevented. Examples of small molecules include but are not limited to small organic molecules, peptides or peptide-like molecules.

Other potential antagonists include antisense molecules (see {Okano, H. et al., 1991}; OLIGODEOXYNUCLEOTIDES AS ANTISENSE INHIBITORS OF GENE EXPRESSION; CRC Press, Boca Ration, Fla. (1988), for a description of these molecules).

Preferred potential antagonists include derivatives of the hyperimmune serum reactive antigens and fragments thereof of the invention.

As used herein the activity of a hyperimmune serum reactive antigen and fragment thereof according to the present invention is its capability to bind to any of its interaction partner or the extent of such capability to bind to its or any interaction partner.

In a particular aspect, the invention provides the use of the hyperimmune serum reactive antigens and fragments thereof, nucleic acid molecules or inhibitors of the invention to interfere with the initial physical interaction between a pathogen and mammalian host responsible for sequelae of infection. In particular the molecules of the invention may be used: i) in the prevention of adhesion of *S. pneumoniae* to mammalian extracellular matrix proteins at mucosal surfaces and on in-dwelling devices or to extracellular matrix proteins in wounds; ii) to block bacterial adhesion between mammalian extracellular matrix proteins and bacterial proteins which mediate tissue damage or invasion iii) or lead to evasion of immune defense; iv) to block the normal progression of pathogenesis in infections initiated other than by the implantation of in-dwelling devices or by other surgical techniques, e.g. through inhibiting nutrient acquisition {Brown, J. et al., 2001}.

Each of the DNA coding sequences provided herein may be used in the discovery and development of antibacterial compounds. The encoded protein upon expression can be used as a target for the screening of antibacterial drugs. Additionally, the DNA sequences encoding the amino terminal regions of the encoded protein or Shine-Delgarno or other translation facilitating sequences of the respective mRNA can be used to construct antisense sequences to control the expression of the coding sequence of interest.

The antagonists and agonists may be employed, for instance, to inhibit diseases arising from infection with *Streptococcus*, especially *S. pneumoniae*, such as sepsis.

In a still further aspect the present invention is related to an affinity device such affinity device comprises as least a support material and any of the hyperimmune serum reactive antigens and fragments thereof according to the present invention, which is attached to the support material. Because of the specificity of the hyperimmune serum reactive antigens and fragments thereof according to the present invention for their target cells or target molecules or their interaction partners, the hyperimmune serum reactive antigens and fragments thereof allow a selective removal of their interaction partner(s) from any kind of sample applied to the support material provided that the conditions for binding are met. The sample may be a biological or medical sample, including but not limited to, fermentation broth, cell debris, cell preparation, tissue preparation, organ preparation, blood, urine, lymph liquid, liquor and the like.

The hyperimmune serum reactive antigens and fragments thereof may be attached to the matrix in a covalent or non-covalent manner. Suitable support material is known to the one skilled in the art and can be selected from the group comprising cellulose, silicon, glass, aluminium, paramagnetic beads, starch and dextrane.

The present invention is further illustrated by the following figures, examples and the sequence listing, from which further features, embodiments and advantages may be taken. It is to be understood that the present examples are given by way of illustration only and not by way of limitation of the disclosure.

In connection with the present invention

FIG. 12 shows the alignment of amino acid sequences of natural SP2216 variants

FIGS. 13A and 13B show the alignment of amino acid sequences of natural SP1732 variants FIGS. 14A-14C show the alignment of amino acid sequences of natural SP2190 variants Table 1 shows the summary of all screens performed with genomic S. pneumoniae libraries and human serum.

Table 2 shows the summary of epitope serology analysis with human sera.

Table 3 shows the summary of the gene distribution analysis for the identified antigens in 50 S. pneumoniae strains.

Table 4 shows the summary of the surface staining and bactericidal activity measurements.

The figures to which it might be referred to in the specification are described in the following in more details.

Figure 1:
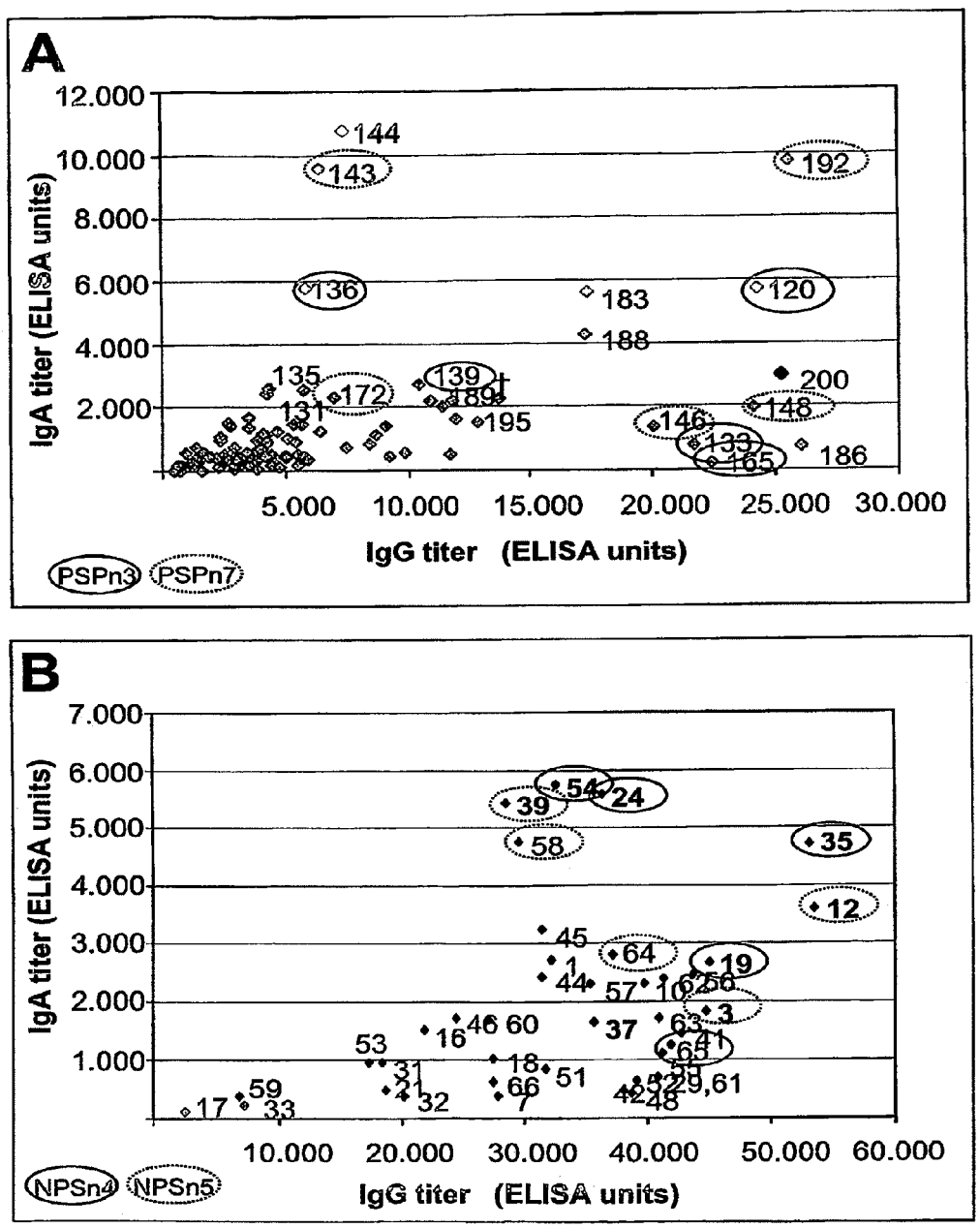
FIG. 1 shows the characterization of S. pneumoniae specific human sera.
Figure 1:
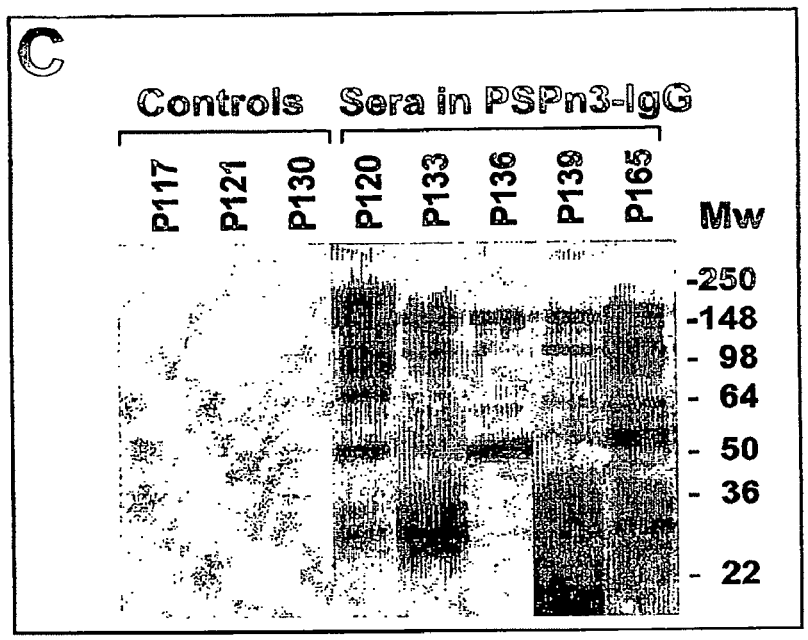
Figure 1:
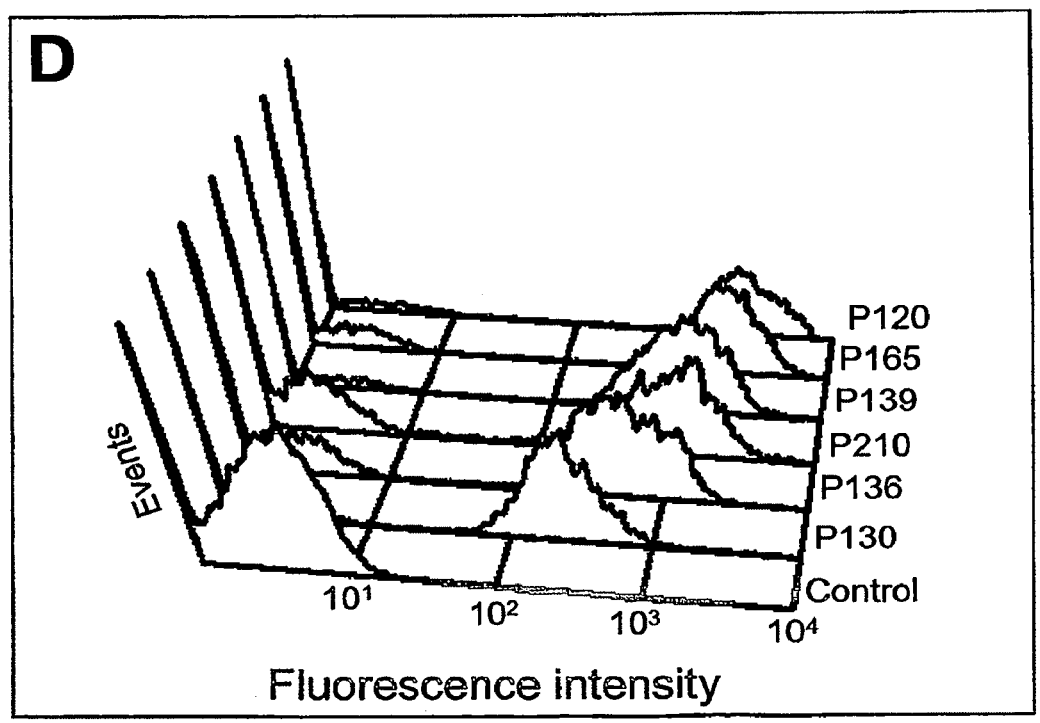
Figure 1:
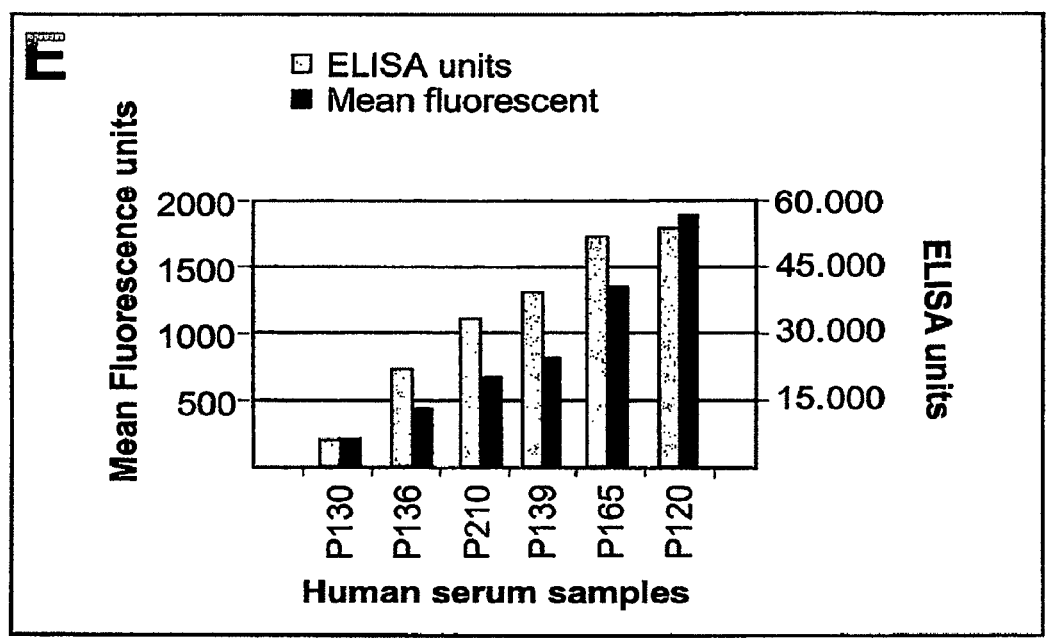

FIG. 1 shows the characterization of human sera for anti-S. pneumoniae antibodies as measured by immune assays. Total anti-S. pneumoniae IgG and IgA antibody levels were measured by standard ELISA using total bacterial lysates or culture supernant fractions prepared from S. pneumoniae serotype 4 capsule negative mutant strain as coating antigens. 97 serum samples from convalescing patients with invasive diseases or 50 sera from healthy adults without nasopharyngeal carriage of S. pneumoniae were analysed at three different serum dilutions. Results of representative experiments are shown with (A) patients' sera with bacterial lysate and (B) healthy adult sera with culture supernatant proteins. Data are expressed as ELISA units calculated from absorbance at 405 nm at a serum dilution in the linear range of detection (10.000× for IgA, 50,000 for IgG). 2×5 sera from both donor groups were selected and pooled for antigen identification by bacterial surface display. Selected sera included in the two patient (PSPn3-IgG, -IgA and PSPn7-IgG) and two healthy pools (NSPn4-IgG, -IgA and NSPn5-IgG) are indicated by circles. (C) Immunoblot analysis was performed on sera pre-selected by ELISA in order to ensure multiple immune reactivity with protein antigens. Results of a representative experiment using total bacterial lysate prepared from S. pneumoniae serotype 4 capsule negative mutant strain and selected patients' sera at 5.000× dilution are shown. Not selected, low titer sera were included as negative controls. Mw: molecular weight markers. (D) Surface staining of S. pneumoniae serotype 4 capsule negative mutant strain was performed by FACS to compare antibody binding to surface located antigens. Human sera were used at different concentrations (0.5-5%). Representative data are shown with patients' sera used at 0.5% final concentration. Signal was detected with FITC-labeled anti-human IgGFab and analysed with the computer program CELLQuest. (E) Correlation between IgG titers measured by ELISA using total bacterial lysates and surface staining of whole living S. pneumoniae with serum IgGs is shown. IgG titer is expressed as ELISA units, while surface staining is expressed as mean fluorescence of stained bacteria calculated by the computer program CELLQuest.

Figure 2:
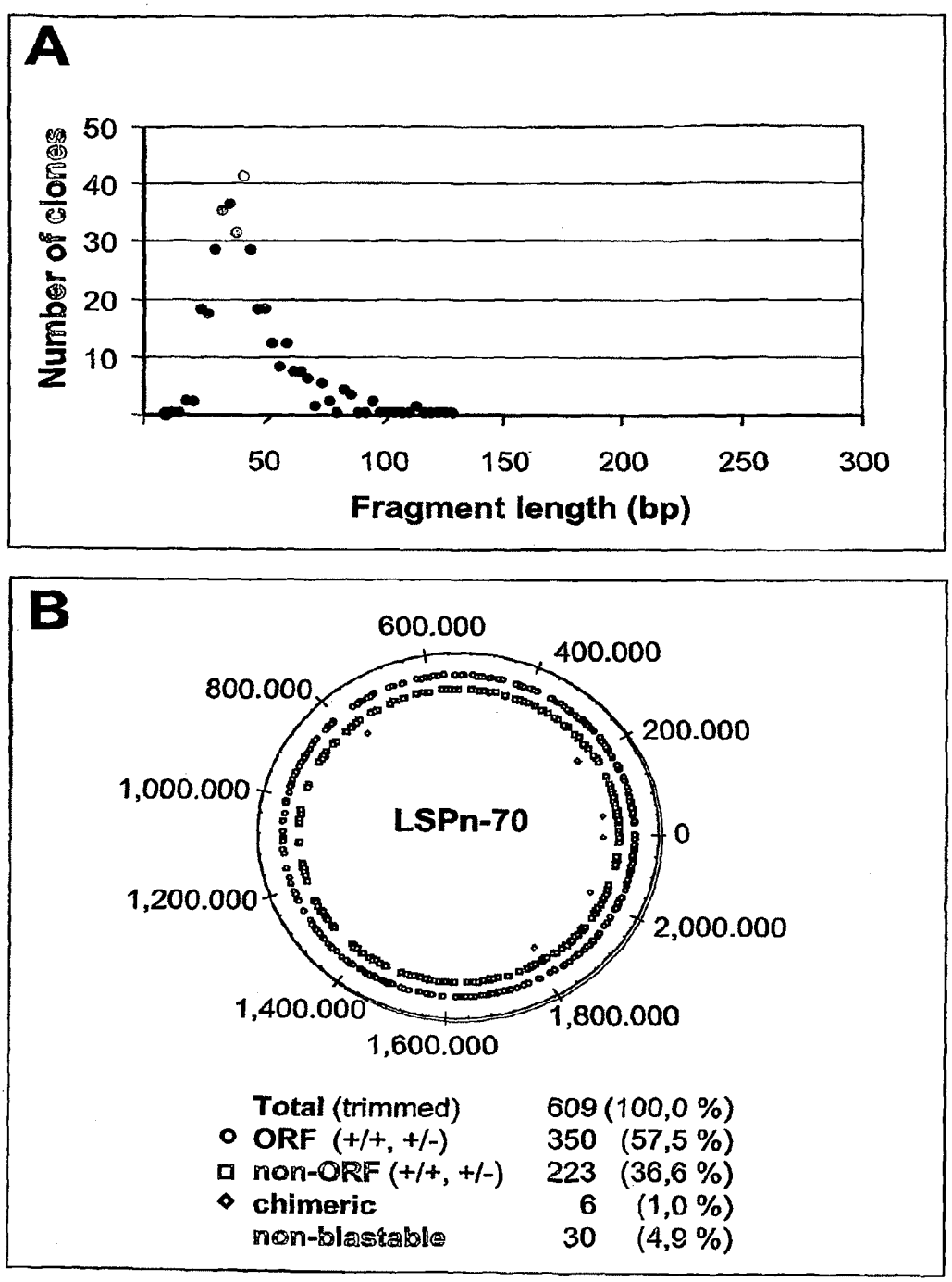
FIG. 2 shows the characterization of the small fragment genomic library, LSPn-70, from Streptococcus pneumoniae serotype 4.

FIG. 2 (A) shows the fragment size distribution of the Streptococcus pneumoniae type 4 small fragment genomic library, LSPn-70. After sequencing 609 randomly selected clones sequences were trimmed to eliminate vector residues and the number of clones with various genomic fragment sizes were plotted. (B) shows graphic illustration of the distribution of the same set of randomly sequenced clones of LSPn-70 over the S. pneumoniae chromosome (according to the TIGR4 genome data). Circles indicate matching sequences to annotated ORFs and rectangles represent fully matched clones to non-coding chromosomal sequences in +/+ or +/− orientation. Diamonds position all clones with chimeric sequences. Numeric distances in base pairs are indicated over the circular genome for orientation. Partitioning of various clone sets within the library is given in numbers and percentage at the bottom of the figure.

Figure 3:
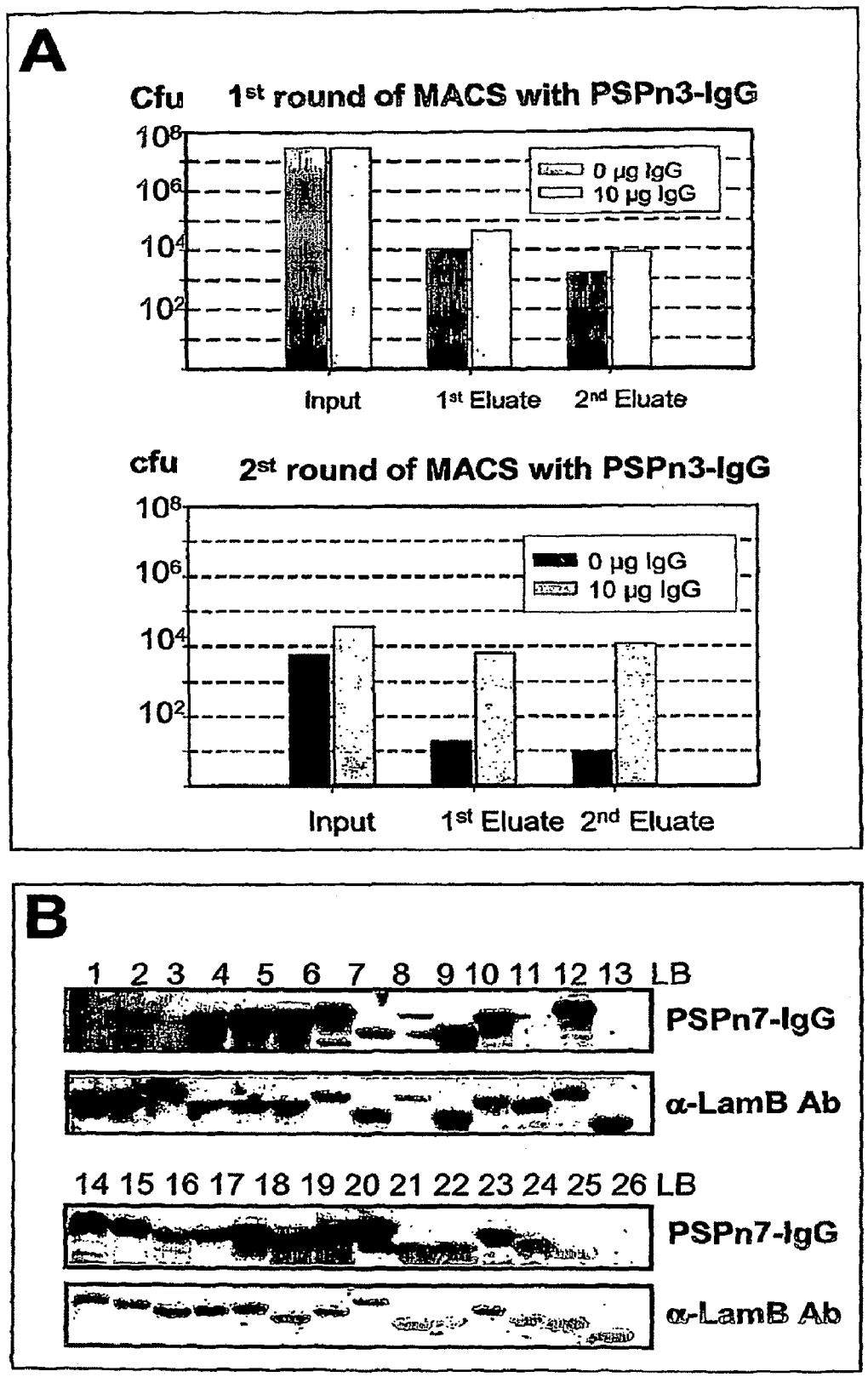
FIG. 3 shows the selection of bacterial cells by MACS using biotinylated human IgGs.

FIG. 3 (A) shows the MACS selection with biotinylated human IgGs. The LSPn-70 library in pMAL9.1 was screened with 10 µg biotinylated IgG (PSPn3-IgG, purified from human serum). As negative control, no serum was added to the library cells for screening. Number of cells selected after the $1^{st}$ and $2^{nd}$ elution are shown for each selection round (upper and lower panel, respectively). (B) shows the reactivity of specific clones (1-26) selected by bacterial surface display as analysed by immunoblot analysis with the human serum IgG pool (PSPn7-IgG, 4 µg/µl) used for selection by MACS at a dilution of 1:3,000. As a loading control the same blot was also analysed with antibodies directed against the platform protein LamB at a dilution of 1:5,000 of hyperimmune rabbit serum. LB, Extract from a clone expressing LamB without foreign peptide insert.

Figure 4:
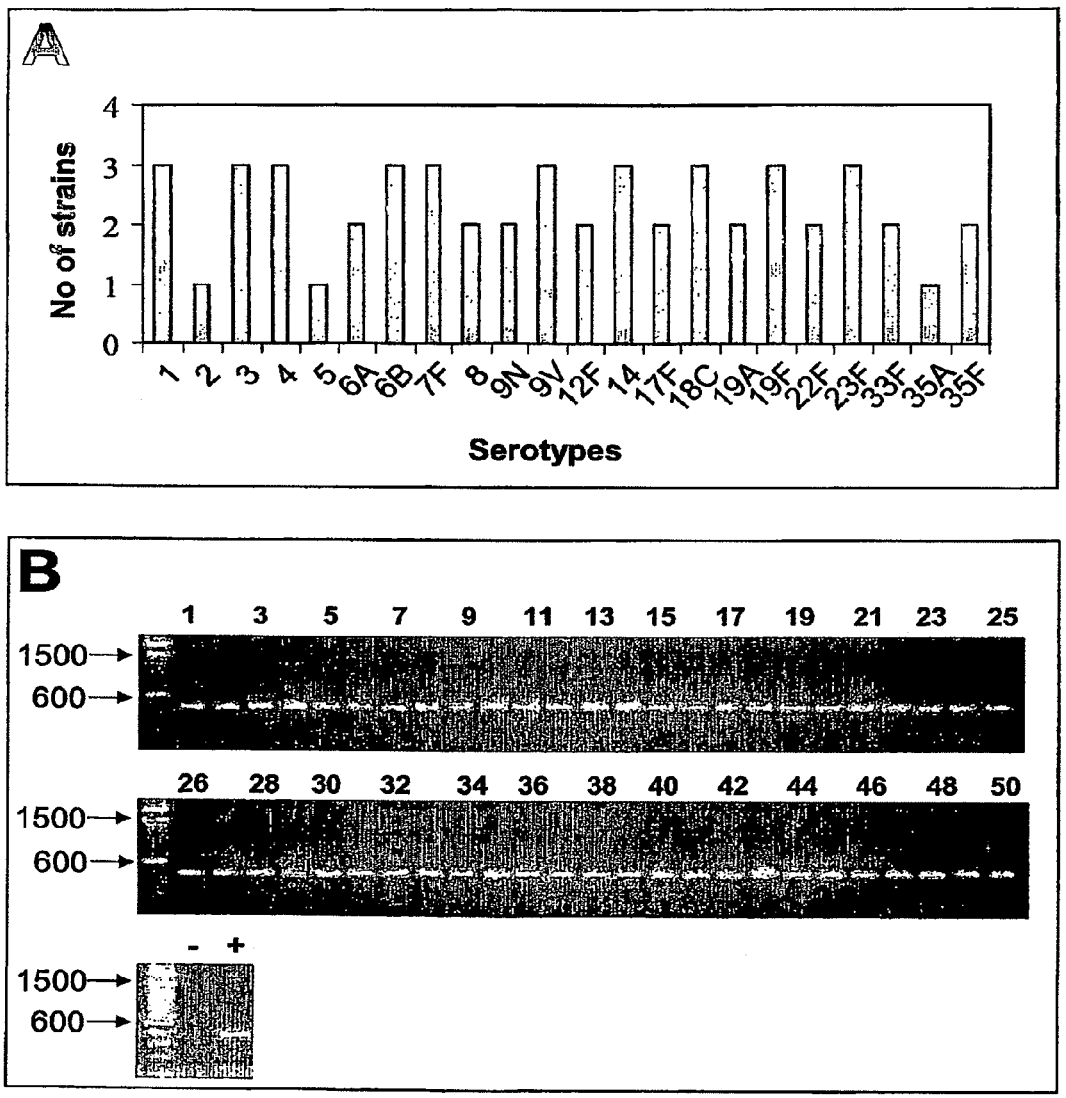
FIG. 4 shows an example for the gene distribution study with the identified antigens.

FIG. 4 (A) shows the representation of different serotypes of S. pneumoniae clinical isolates analysed for the gene distribution study. (B) shows the PCR analysis for the gene distribution of SP1604 with the respective oligonucleotides. The predicted size of the PCR fragments is 470 bp. 1-50, S.

*pneumoniae* strains, clinical isolates as listed under A; −, no genomic DNA added; +, genomic DNA from *S. pneumoniae* serotype 4, which served as template for library construction.

Figure 5:
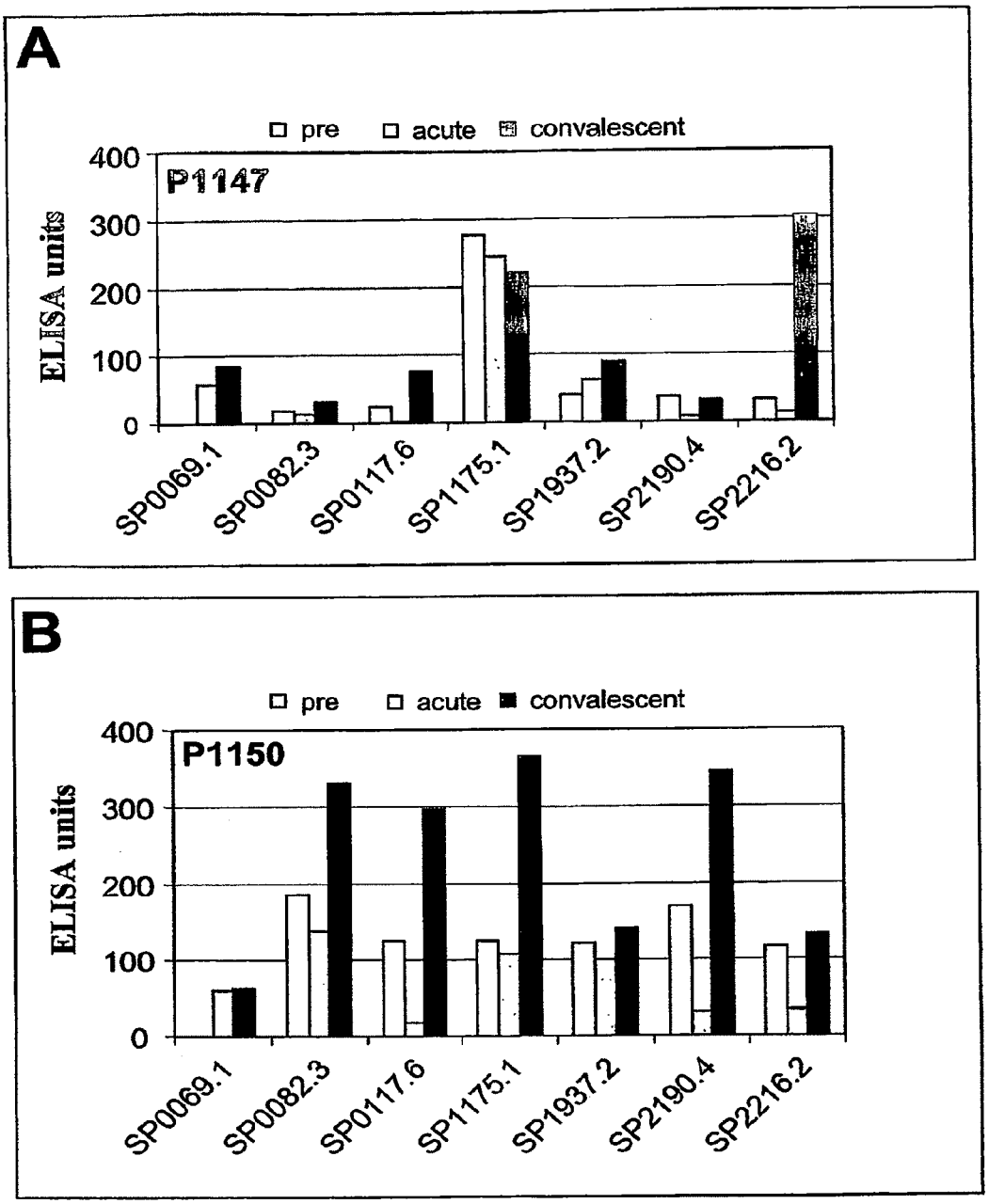
FIG. 5 shows examples of changes in epitope-specific antibody levels in the different age groups and during the course of pneumococcal disease.

FIG. 5 shows the ELISA measurement of epitope-specific human serum IgG antibody levels during pneumococcal disease. Three serum samples were collected longitudinally from patients with invasive pneumococcal disease, before disease occurred (pre), in the acute and convalescent phases. Representative experiments are shown with two sets of sera from two different patients, (A) P1147 and (B) P1150 reacted with peptides representing the identified antigens SP0069, SP0082, SP0117, SP1175, SP1937, SP2190 and SP2216, as indicated. Biotin-labeled peptides were reacted with human serum samples at 200× and 1.000× dilutions and data are expressed as ELISA units.

Figure 6:
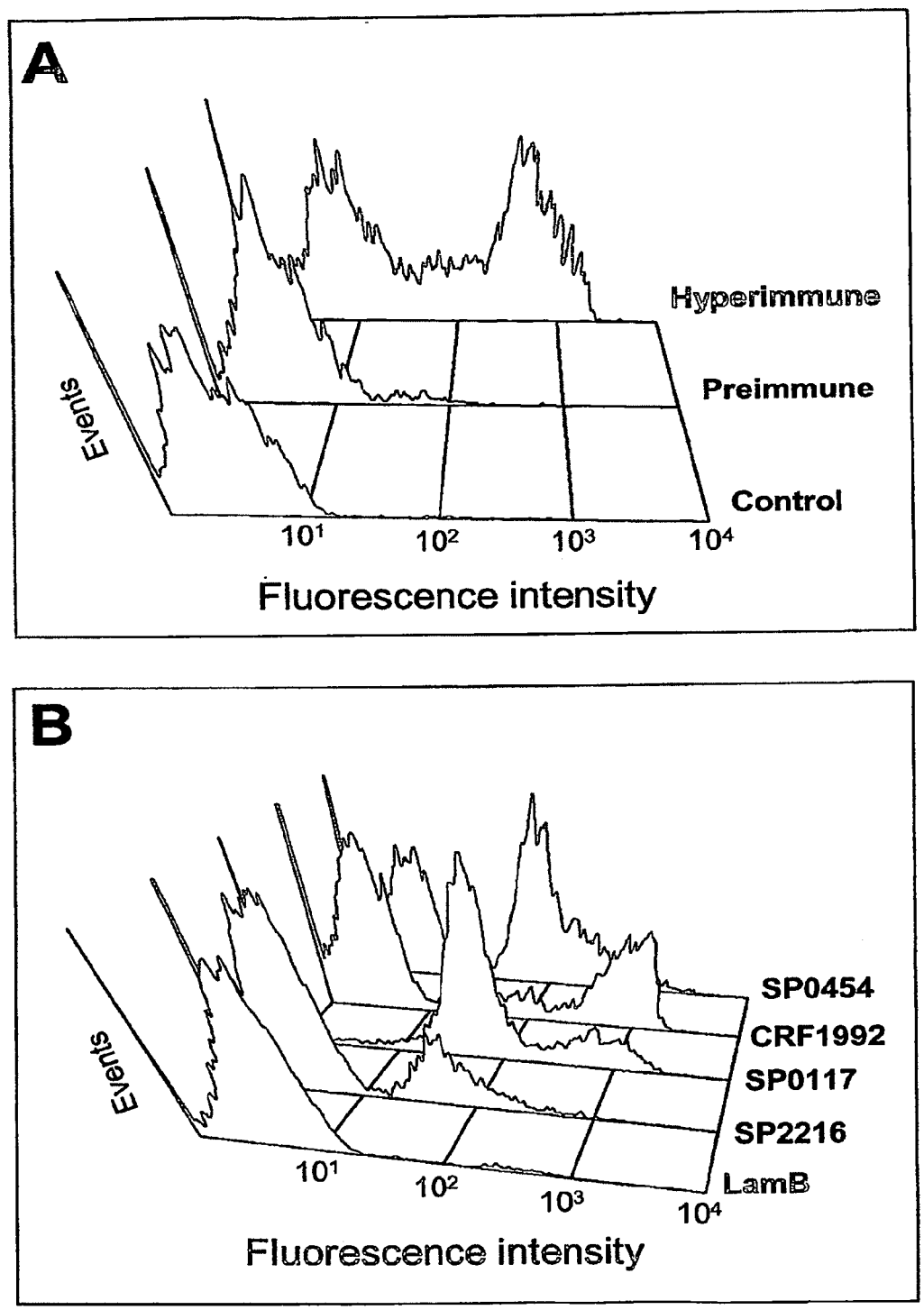
FIG. 6 shows examples for cell surface staining with epitope-specific antisera by flow cytometry.

FIG. 6 shows the detection of specific antibody binding on the cell surface of *Streptococcus pneumoniae* by flow cytometry. In FIG. 5A preimmune mouse sera and polyclonal sera raised against *S. pneumoniae* serotype 4 lysate were incubated with *S. pneumoniae* strain serotype 4 and analysed by flow cytometry. Control shows the level of non-specific binding of the secondary antibody to the surface of *S. pneumoniae* cells. The histograms in FIG. 5B indicates the increased fluorescence due to specific binding of anti-SP2216, anti-SP0117, anti-SP0454 and anti-CRF1992 antibodies in comparison to the control sera against the platform protein LamB.

Figure 7:
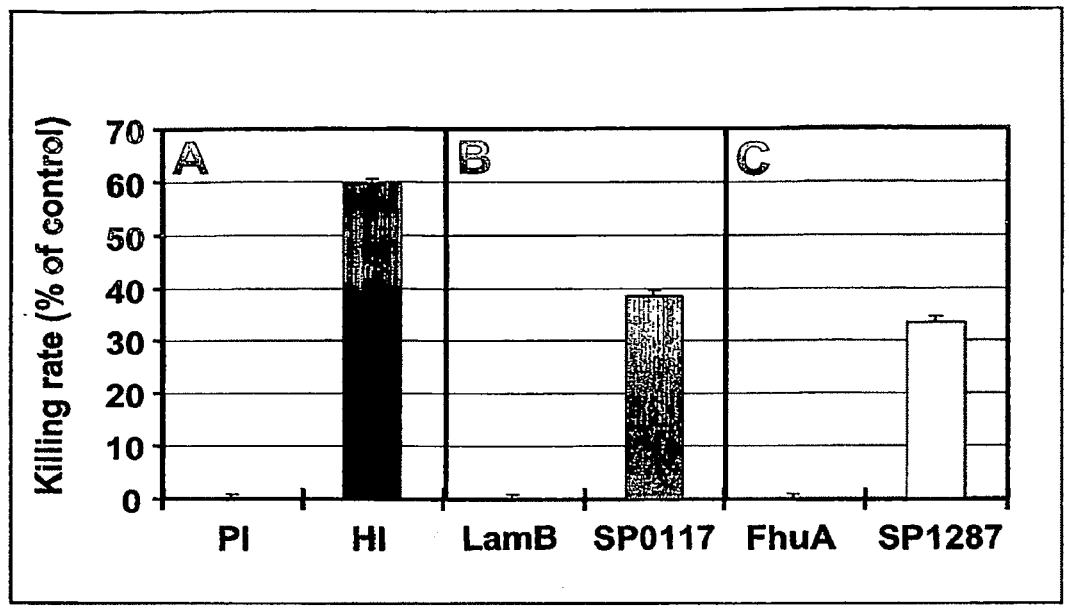
FIG. 7 shows the determination of bactericidal activity of antibodies induced by selected epitopes in an in vitro assay.

FIG. 7 shows the bactericidal activity of epitope specific antibodies as determined in in vitro killing assay. The killing activity of immune sera is measured parallel with and calculated relative to the appropriate control sera. Data are expressed as percentage of killing, that is the reduction on bacterial cfu numbers as a consequence of the presence of antibodies in hyperimmune (HI) polyclonal mouse sera generated with *S. pneumoniae* lysate (A), in immune sera generated with SP0117 epitopes expressed in the LamB platform protein (B), and in mouse immune sera generated with SP1287 epitopes expressed in the FhuA platform protein (C). The control sera represent preimmune sera (PI), sera induced with Lamb or FhuA expressing *E. coli* clones without *S. pneumonia*-derived epitopes. *S. pneumonaie* serotype 4 cells were incubated with mouse phagocytic cells for 60 min, and surviving bacteria were quantified by counting cfus after plating on blood agar.

Figure 8:
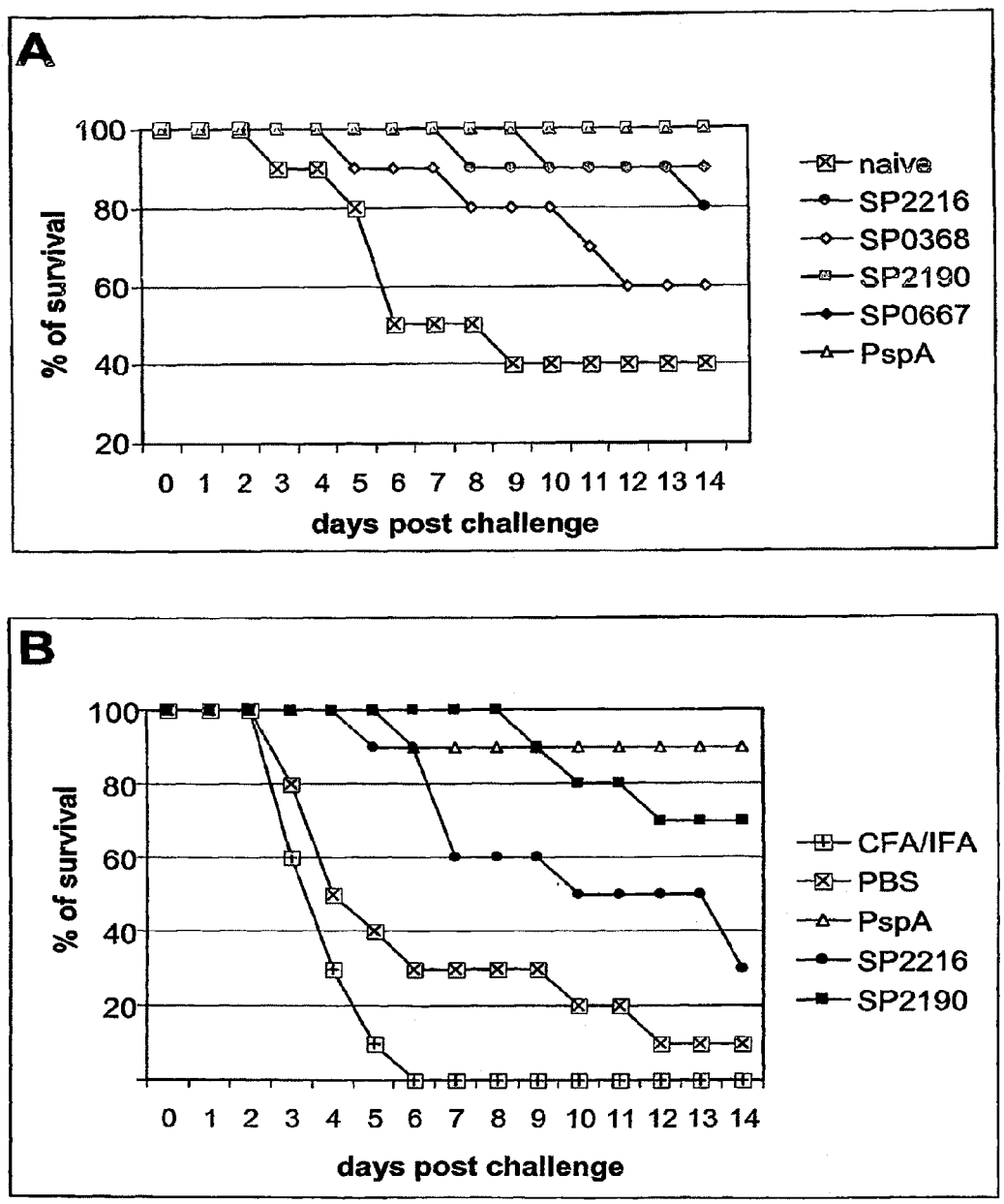
FIG. 8 shows the protective effect of active immunization with selected S. pneumoniae antigens in a murine lethality sepsis model.
Figure 8:
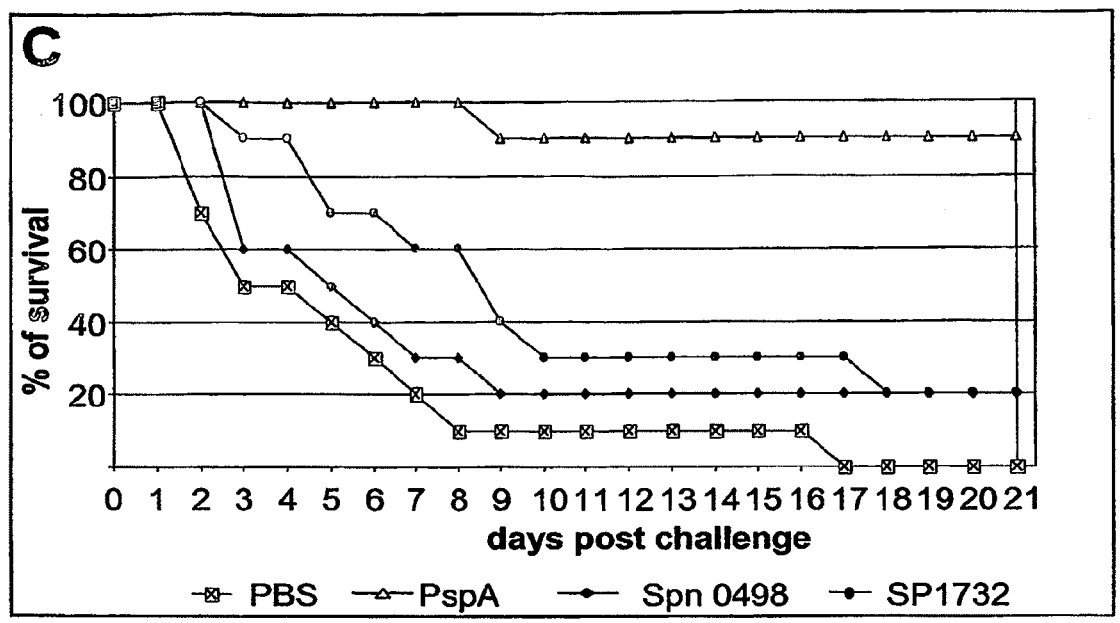

FIG. 8 shows the protection achieved by active immunization with selected *S. pneumoniae* antigens in a mouse lethality model. C3H mice (10 in each test groups) were immunized with recombinant antigens cloned from a serotype 4 *S. pneumoniae* strain and challenged with serotype 6B strain. Survival was monitored for 2 to 3 weeks post-challenge. A: Mice were immunized with SP0368, SP0667, SP2190 and SP2216 antigens and challenged intravenously with $10^4$ cfu bacteria. Nonimmunized mice were used as negative controls, while PspA (SP0117) served as positive control. B: Mice were immunized with SP2190 and SP2216 antigens and challenged intraperitoneally with $10^5$ cfu bacteria. Mice injected with PBS or mock immunized with the adjuvants only (CFA/IFA) were used as negative controls, while PspA (SP0117) served as positive control. C: Mice were immunized with SP0498 and SP1732 antigens and challenged intraperitoneally with $10^5$ cfu bacteria. Mice injected with PBS were used as negative controls, while PspA (SP0117) served as positive control.

Figure 9:
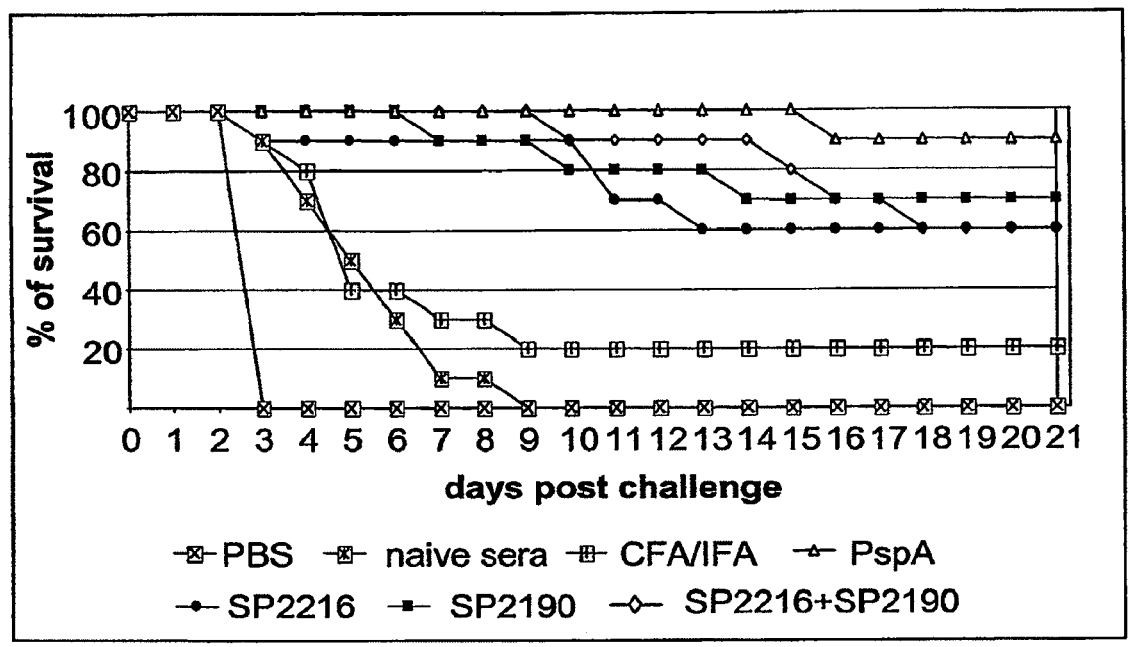
FIG. 9 shows the protective effect of passive immunization with sera generated with selected S. pneumoniae antigens in a murine lethality sepsis model.

FIG. 9 shows the protection achieved by passive immunization with hyperimmune mouse sera generated with selected *S. pneumoniae* antigens in a mouse lethality model. C3H mice (10 in each test groups) were given mouse sera intraperitoneally 2 hrs before intraperitoneal challenge with $10^5$ cfu *S. pneumoniae* serotype 6B bacteria. Survival was monitored for 3 weeks post-challenge. 150 µl immune sera generated with SP2190 or SP2216 were given and supplemented with 150 µl serum from naive mice, except for mice receiving 100 µl each of anti-SP2190, anti-SP2216 immune sera and 100 µl serum from naive mice. Negative controls were treated either with 300 µl sera from PBS injected, noninjected (naive) or nonimmune CFA/IFA injected mice.

Figure 10:
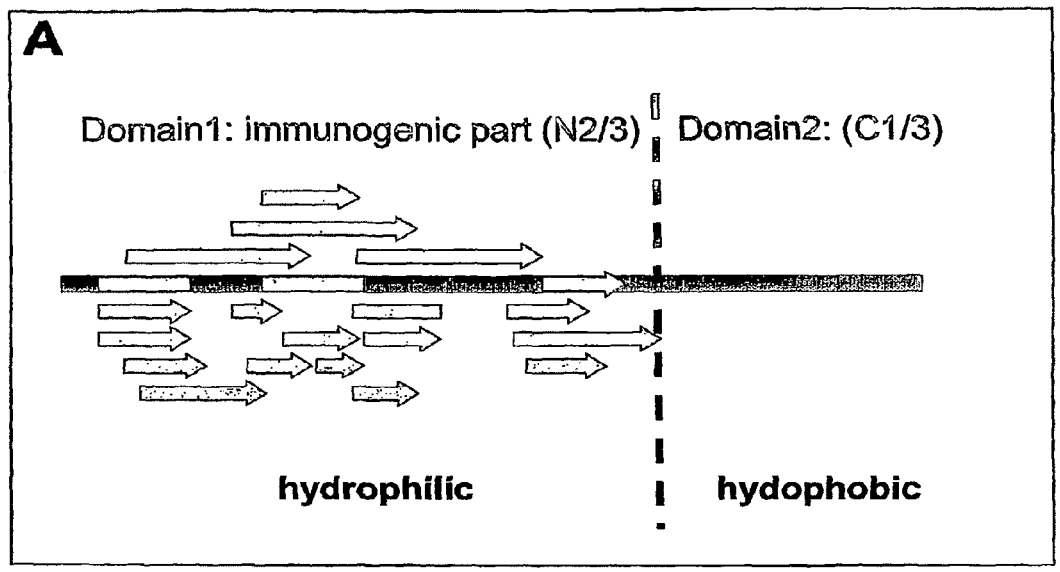
FIG. 10 shows the identification of the protective domain within the SP2216 antigen.
Figure 10:
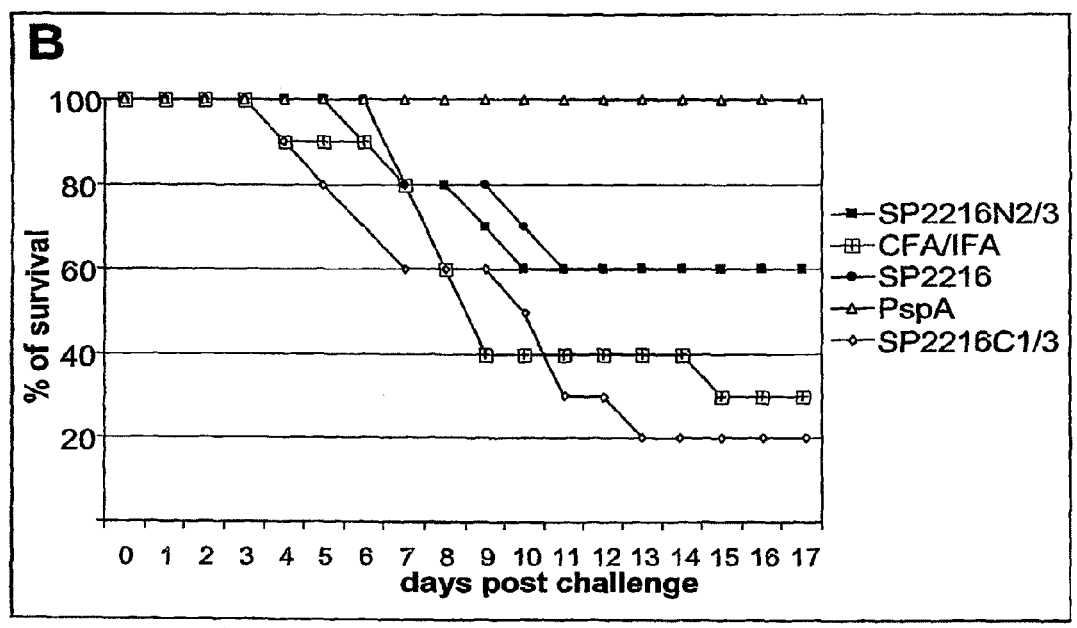

FIG. 10 shows the identification of the protective domain within the SP2216 antigen. A: Schematic representation of the SP2216 antigen indicating the two subdomains predicted by in silico (structural prediction) analysis and the localization of epitopes identified by bacterial surface display (grey bars and arrows). B: C3H mice (10 in each test groups) were immunized with recombinant SP2216 antigens: full-length, N-terminal or C-terminal domains and challenged with *S. pneumoniae* serotype 6B strain given intraperitoneally $10^5$ cfus. Survival was monitored for 2 to 3 weeks post-challenge. Nonimmunized (CFA/IFA adjuvant injected) mice were used as negative controls, while PspA (SP0117) served as positive control.

Figure 11:
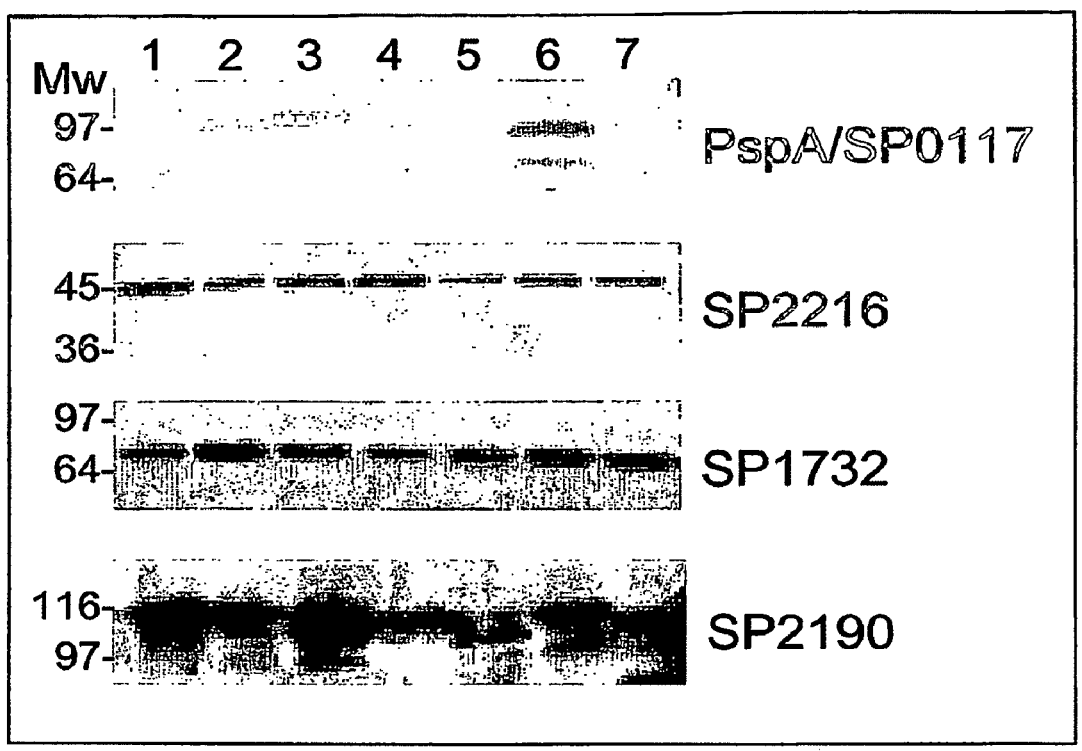
FIG. 11 shows that antibodies induced by protective antigens are cross-reactive with the different S. pneumoniae serotypes.

FIG. 11 shows the cross-reactivity of antibodies by analysing different *S. pneumoniae* serotypes Immunoblot analysis was performed with bacterial lysates prepared from 60 clinical isolates of *S. pneumoniae* representing 48 different serotypes and using sera generated with SP1732, SP2190 and SP2216 recombinant antigens cloned from a serotype 4 strain in order to test the cross-reactivity of antibodies. Results with seven different serotypes (Lanes 1-7) are shown as representative data taken from the complete analysis. Mw: molecular weight markers.

FIG. 12 shows the amino acid exchanges detected in natural SP2216 variants expressed in different clinical isolates of *S. pneumoniae*. The SP2216 gene from 47 different clinical isolates representing 47 different *S. pneumoniae* serotypes were analysed by DNA sequencing. The translated amino acid sequences are shown for those serotypes where amino acid exchanges were detected relative to the published TIGR4 genome sequences.

FIGS. 13A and 13B show the amino acid exchanges detected in natural SP1732 variants expressed in different clinical isolates of *S. pneumoniae*. The SP1732 gene from six different clinical isolates representing six major *S. pneumoniae* serotypes (4, 6B, 9V, 18C, 19F, 23F) were analysed by DNA sequencing. The translated amino acid sequences are shown for those serotypes where amino acid exchanges were detected relative to the published TIGR4 (serotype 4) genome sequences.

FIGS. 14A-14C show the amino acid exchanges detected in natural SP2190 variants expressed in different clinical isolates of *S. pneumoniae*. The SP2190 gene from seven different clinical isolates representing seven major *S. pneumoniae* serotypes (4, 6B, 9V, 14, 18C, 19F, 23F) were analysed by DNA sequencing. The translated amino acid sequences are shown for those serotypes where amino acid exchanges were detected relative to the published TIGR4 (serotype 4) genome sequences. Due to missing sequence information from the middle part of some of the genes, the N-terminal and C-terminal aa alignments are shown separately. A: N-terminal amino acid sequences; B: C-terminal amino acid sequences.

Table 1: Immunogenic Proteins Identified by Bacterial Surface Display.

A, 300 bp library in fhuA with NSPn4-IgA (362), B, 300 bp library in fhuA with NSPn4-IgG (832), C, 300 bp library in fhuA with NSPn5-IgG (872), D, 300 bp library in fhuA with PSPn3-IgA (361), E, 300 bp library in fhuA with PSPn3-IgG (575), F, 300 bp library in fhuA with PSPn7-IgG (795), G, 70 bp library in lamB with NSPn4-IgA (1043), H, 70 bp library in lamB with NSPn4-IgG (929), I, 70 bp library in lamB with NSPn5-IgG (527), K, 70 bp library in lamB with PSPn3-IgA (1121), L, 70 bp library in lamB with PSPn3-IgG (1242), M, 70 bp library in lamB with PSPn7-IgG (514); *, prediction of antigenic sequences longer than 5 amino acids was performed with the program ANTIGENIC {Kolaskar, A. et al., 1990}.

Table 2: Epitope Serology with Human Sera.

Immune reactivity of individual synthetic peptides representing selected epitopes with individual human sera is shown. Extent of reactivity is pattern/grey coded; white: − (<50 U), light grey: + (50-119 U), dark grey: ++ (120-199 U), black: +++ (200-500 U) and vertically crossed: ++++ (<500 U). ELISA units (U) are calculated from $OD_{405nm}$ readings and the serum dilution after correction for background. S stands for score, calculated as the sum of all reactivities (addition of the number of all +); P1 to P13 sera are measured to be high titer and are from patients with invasive pneumococcal diseases and N1 to N10 sera are from healthy adults with high anti-*S. pneumoniae* titers. S stands for score. Which is the sum of immune reactivities: −=0; +=1; ++=2; +++=3 and ++++=4. Location of synthetic peptides within the antigenic ORFs according to the genome annotation of TIGR4 strain are given in columns from and to indicating the first and last amino acid residues, respectively. Peptide names: SP0117.1-7 present in annotated ORFSP0117; ARF0408.1, potential novel ORF in alternative reading-frame of SP0408; CRF0129.1, potential novel ORF on complement of SP0129.

Table 3: Gene Distribution in *S. pneumoniae* Strains.

Fifty *S. pneumoniae* strains as shown in FIG. 4A were tested by PCR with oligonucleotides specific for the genes encoding relevant antigens. The PCR fragment of one selected PCR fragment was sequenced in order to confirm the amplification of the correct DNA fragment. *, number of amino acid substitutions in a serotype 14 strain as compared to *S. pneumoniae* TIGR4 (serotype 4). #, alternative strain used for sequencing, because gene was not present in the serotype 14 strain.

Table 4: Surface Location of Antigenic Epitopes and the Functionality of the Epitope-Specific Antibodies.

45 *S. pneumoniae* antigens were tested for surface localization in the way described and presented in FIG. 6 by using mouse sera generated by immunization with *E. coli* clones harboring plasmids encoding the platform proteins LamB or FhuA fused to a *S. pneumoniae* peptide. Data are summarized in the column labeled FACS. The very same immune reagents were used in an in vitro killing assay, as shown in FIG. 7 for the examples, and presented for all antigens tested positive by FACS in column PK (phagocytic killing). −: negative result, +: not consistently positive in all assays performed, ++ and +++ are consistently positive relative to control reagents.

EXAMPLES

Example 1

Characterization and Selection of Human Sera Based Anti-*S. pneumoniae* Antibodies, Preparation of Antibody Screening Reagents Experimental Procedures
Enzyme Linked Immune Assay (ELISA).
ELISA plates (Maxisorb, Millipore) were coated with 5-10 μg/ml total protein diluted in coating buffer (0.1M sodium carbonate pH 9.2). Three dilutions of sera (2,000×, 10,000×, 50,000×) were made in PBS-BSA. Highly specific Horse Radish Peroxidase (HRP)-conjugated anti-human IgG or anti-human IgA secondary antibodies (Southern Biotech) were used according to the manufacturers' recommendations (dilution: 1,000×). Antigen-antibody complexes were quantified by measuring the conversion of the substrate (ABTS) to colored product based on $OD_{405nm}$ readings by automatic ELIAS reader (TECAN SUNRISE).

Preparation of Bacterial Antigen Extracts

Total bacterial lysate: Bacteria were grown overnight in THB (Todd-Hewitt Broth) and lysed by repeated freeze-thaw cycles: incubation on dry ice/ethanol-mixture until frozen (1 min), then thawed at 37° C. (5 min): repeated 3 times. This was followed by sonication and collection of supernatant by centrifugation (3,500 rpm, 15 min, 4° C.).

Culture supernatant: After removal of bacteria by centrifugation, the supernatant of overnight grown bacterial cultures was precipitated with ice-cold ethanol by mixing 1 part supernatant with 3 parts abs. ethanol and incubated overnight at −20° C. Precipitates were collected by centrifugation (2,600 g, for 15 min). Dry pellets were dissolved either in PBS for ELISA, or in urea and SDS-sample buffer for SDS-PAGE and immunoblotting. The protein concentration of samples was determined by Bradford assay.

Immunoblotting

Total bacterial lysate and culture supernatant samples were prepared from in vitro grown *S. pneumoniae* serotype 4 uncapsulated mutant strain. 10 to 25 μg total protein/lane was separated by SDS-PAGE using the BioRad Mini-Protean 3 Cell electrophoresis system and proteins transferred to nitrocellulose membrane (ECL, Amersham Pharmacia). After overnight blocking in 5% milk, human sera were added at 2,000× dilution, and HRPO labeled anti-human IgG was used for detection.

Surface Staining of Bacteria

Flow cytometric analysis was carried out as follows. *S. pneumoniae* serotype 4 uncapsulated mutant strain was grown in Todd-Hewitt broth overnight until early stationary phase. Cells were collected and washed twice in Hanks Balanced Salt Solution (HBSS) and the cell density was adjusted to approximately $1 \times 10^6$ CFU in 1000 HBSS with 0.5% BSA based on OD600 nm readings. After incubation with human sera at 0.5 and 2% final concentration for 60 min at 4° C., unbound antibodies were washed away by centrifugation in excess HBSS, 0.5% BSA. For detection fluorescein (FITC) labeled secondary goat anti-human IgG (F(ab'$_2$ fragment specific) was incubated with the cells at 4° C. for 30 min. After washing the cells, cells were fixed with 2% paraformaldehyde. Surface staining antibodies were detected using a Becton Dickinson FACScan flow cytometer and data further analyzed with the computer program CELLQuest.

Purification of antibodies for genomic screening. Five sera from both the patient and the healthy group were selected based on the overall anti-streptococcal titers for a serum pool used in the screening procedure. Antibodies against *E. coli* proteins were removed by incubating the heat-inactivated sera with whole cell *E. coli* cells (DH5alpha, transformed with pHIE11, grown under the same condition as used for bacterial surface display). Highly enriched preparations of IgGs from the pooled, depleted sera were generated by protein G affinity chromatography, according to the manufacturer's instructions (UltraLink Immobilized Protein G, Pierce). IgA antibodies were purified also by affinity chromatography using biotin-labeled anti-human IgA (Southern Biotech) immobilized on Streptavidin-agarose (GIBCO BRL). The efficiency of depletion and purification was checked by SDS-PAGE, Western blotting, ELISA and protein concentration measurements.

Results

The antibodies produced against *S. pneumoniae* by the human immune system and present in human sera are indicative of the in vivo expression of the antigenic proteins and their immunogenicity. These molecules are essential for the identification of individual antigens in the approach as described in the present invention, which is based on the interaction of the specific anti-streptococcal antibodies and the corresponding *S. pneumoniae* peptides or proteins. To gain access to relevant antibody repertoires, human sera were collected from I. convalescent patients with invasive *S. pneumoniae* infections, such as pneumonia, bacteraemia and meningitis. (*S. pneumoniae* was shown to be the causative agent by medical microbiological tests), II healthy adults without carriage at the time of sampling. *S. pneumoniae* colonization and infections are common, and antibodies are present as a consequence of natural immunization from previous encounters.

97 serum samples from patient and 50 sera from healthy adults were characterized for anti-*S. pneumoniae* antibodies by a series of immune assays. Primary characterization was done by ELISA using two different antigen preparations, such as total bacterial extract and culture supernatant proteins prepared from *S. pneumoniae* serotype 4 uncapsulated mutant strain. It is an important aspect that we analysed uncapsulated strain, since we avoided the reactivities coming from serotype specific abundant anti-capsular polysaccharide antibodies.

Recently it was reported that not only IgG, but also IgA serum antibodies can be recognized by the FcRIII receptors of PMNs and promote opsonization {Phillips-Quagliata, J. et al., 2000}; {Shibuya, A. et al., 2000}. The primary role of IgA antibodies is neutralization, mainly at the mucosal surface. The level of serum IgA reflects the quality, quantity and specificity of the dimeric secretory IgA. For that reason the serum collection was not only analyzed for anti-streptococcal IgG, but also for IgA levels. In the ELISA assays highly specific secondary reagents were used to detect antibodies from the high affinity types, such as IgG and IgA, but avoided IgM. Production of IgM antibodies occurs during the primary adaptive humoral response, and results in low affinity antibodies, while IgG and IgA antibodies had already undergone affinity maturation, and are more valuable in fighting or preventing disease. Antibody titers were compared at given dilutions where the response was linear (FIGS. 1A and 1B.). Sera were ranked based on the IgG and IgA reactivity against the two complex antigenic mixtures, and the highest ones were selected for further testing by immunoblotting. This analysis confirmed a high antibody reactivity of the pre-selected sera against multiple pneumococcal proteins, especially when compared to not selected, low-titer sera (FIG. 1C). ELISA ranking of sera also correlated very well with surface staining of the same *S. pneumoniae* strain (FIGS. 1D and 1E) suggesting that the majority of the antibodies detected by ELISA corresponded to surface antigens. This extensive antibody characterization approach has led to the unambiguous identification of anti-pneumococcal hyperimmune sera.

Selected sera, 2×5 from both the patient and healthy donor groups were pooled to further enrich for abundant antibodies, but still having a representation of antibody repertoires of different individuals. IgG and IgA antibodies were purified from pooled sera by affinity chromatography and depleted of *E. coli*-reactive antibodies to avoid background in the bacterial surface display screen.

Example 2

Generation of Highly Random, Frame-Selected, Small-Fragment, Genomic DNA Libraries of *Streptococcus pneumoniae*

Experimental Procedures

Preparation of streptococcal genomic DNA. 50 ml Todd-Hewitt Broth medium was inoculated with *S. pneumoniae* serotype 4 (clinical isolate, typed with conventional serotyping) bacteria from a frozen stab and grown with aeration and shaking for 18 h at 37° C. The culture was then harvested, centrifuged with 1,600×g for 15 min and the supernatant was removed. Bacterial pellets were washed 3× with PBS and carefully re-suspended in 0.5 ml of Lysozyme solution (100 mg/ml). 0.1 ml of 10 mg/ml heat treated RNase A and 20 U of RNase T1 were added, mixed carefully and the solution was incubated for 1 h at 37° C. Following the addition of 0.2 ml of 20% SDS solution and 0.1 ml of Proteinase K (10 mg/ml) the tube was incubated overnight at 55° C. ⅓ volume of saturated NaCl was then added and the solution was incubated for 20 min at 4° C. The extract was pelleted in a microfuge (13,000 rpm) and the supernatant transferred into a new tube. The solution was extracted with PhOH/CHCl$_3$/IAA (25:24:1) and with CHCl$_3$/IAA (24:1). DNA was precipitated at room temperature by adding 0.6× volume of Isopropanol, spooled from the solution with a sterile Pasteur pipette and transferred into tubes containing 80% ice-cold ethanol. DNA was recovered by centrifuging the precipitates with 10-12,000×g, then dried on air and dissolved in ddH$_2$O.

Preparation of small genomic DNA fragments. Genomic DNA fragments were mechanically sheared into fragments ranging in size between 150 and 300 bp using a cup-horn sonicator (Bandelin Sonoplus UV 2200 sonicator equipped with a BB5 cup horn, 10 sec. pulses at 100% power output) or into fragments of size between 50 and 70 bp by mild DNase I treatment (Novagen). It was observed that sonication yielded a much tighter fragment size distribution when breaking the DNA into fragments of the 150-300 bp size range. However, despite extensive exposure of the DNA to ultrasonic wave-induced hydromechanical shearing force, subsequent decrease in fragment size could not be efficiently and reproducibly achieved. Therefore, fragments of 50 to 70 bp in size were obtained by mild DNase I treatment using Novagen's shotgun cleavage kit. A 1:20 dilution of DNase I provided with the kit was prepared and the digestion was performed in the presence of MnCl$_2$ in a 60 μl volume at 20° C. for 5 min to ensure double-stranded cleavage by the enzyme. Reactions were stopped with 2 μl of 0.5 M EDTA and the fragmentation efficiency was evaluated on a 2% TAE-agarose gel. This treatment resulted in total fragmentation of genomic DNA into near 50-70 bp fragments. Fragments were then blunt-ended twice using T4 DNA Polymerase in the presence of 100 μM each of dNTPs to ensure efficient flushing of the ends. Fragments were used immediately in ligation reactions or frozen at −20° C. for subsequent use.

Description of the vectors. The vector pMAL4.31 was constructed on a pASK-IBA backbone {Skerra, A., 1994} with the beta-lactamase (bla) gene exchanged with the Kanamycin resistance gene. In addition the bla gene was cloned into the multiple cloning site. The sequence encoding mature beta-lactamase is preceded by the leader peptide sequence of ompA to allow efficient secretion across the cytoplasmic membrane. Furthermore a sequence encoding the first 12 amino acids (spacer sequence) of mature beta-lactamase follows the ompA leader peptide sequence to avoid fusion of sequences immediately after the leader peptidase cleavage site, since e.g. clusters of positive charged amino acids in this region would decrease or abolish translocation across the cytoplasmic membrane {Kajava, A. et al., 2000}. A SmaI restriction site serves for library insertion. An upstream FseI site and a downstream NotI site, which were used for recovery of the selected fragment, flank the SmaI site. The three restriction sites are inserted after the sequence encoding the 12 amino acid spacer sequence in such a way that the bla gene is transcribed in the −1 reading frame resulting in a stop codon 15 bp after the NotI site. A +1 bp insertion restores the bla ORF so that beta-lactamase protein is produced with a consequent gain of Ampicillin resistance.

The vector pMAL9.1 was constructed by cloning the lamB gene into the multiple cloning site of pEH1 {Hashemzadeh-Bonehi, L. et al., 1998}. Subsequently, a sequence was inserted in lamB after amino acid 154, containing the restriction sites FseI, SmaI and NotI. The reading frame for this insertion was constructed in such a way that transfer of frame-selected DNA fragments excised by digestion with FseI and NotI from plasmid pMAL4.31 yields a continuous reading frame of lamB and the respective insert.

The vector pMAL10.1 was constructed by cloning the btuB gene into the multiple cloning site of pEH1. Subsequently, a sequence was inserted in btuB after amino acid 236, containing the restriction sites FseI, XbaI and NotI. The reading frame for this insertion was chosen in a way that transfer of frame-selected DNA fragments excised by digestion with FseI and NotI from plasmid pMAL4.31 yields a continuous reading frame of btuB and the respective insert.

The vector pHIE11 was constructed by cloning the fhuA gene into the multiple cloning site of pEH1. Thereafter, a sequence was inserted in fhuA after amino acid 405, containing the restriction site FseI, XbaI and NotI. The reading frame for this insertion was chosen in a way that transfer of frame-selected DNA fragments excised by digestion with FseI and NotI from plasmid pMAL4.31 yields a continuous reading frame of fhuA and the respective insert.

Cloning and evaluation of the library for frame selection. Genomic S. pneumoniae DNA fragments were ligated into the SmaI site of the vector pMAL4.31. Recombinant DNA was electroporated into DH10B electrocompetent E. coli cells (GIBCO BRL) and transformants plated on LB-agar supplemented with Kanamycin (50 µg/ml) and Ampicillin (50 µg/ml). Plates were incubated over night at 37° C. and colonies collected for large scale DNA extraction. A representative plate was stored and saved for collecting colonies for colony PCR analysis and large-scale sequencing. A simple colony PCR assay was used to initially determine the rough fragment size distribution as well as insertion efficiency. From sequencing data the precise fragment size was evaluated, junction intactness at the insertion site as well as the frame selection accuracy (3n+1 rule).

Cloning and evaluation of the library for bacterial surface display. Genomic DNA fragments were excised from the pMAL4.31 vector, containing the S. pneumoniae library with the restriction enzymes FseI and NotI. The entire population of fragments was then transferred into plasmids pMAL9.1 (LamB) or pHIE11 (FhuA), which have been digested with FseI and NotI. Using these two restriction enzymes, which recognise an 8 bp GC rich sequence, the reading frame that was selected in the pMAL4.31 vector is maintained in each of the platform vectors. The plasmid library was then transformed into E. coli DH5alpha cells by electroporation. Cells were plated onto large LB-agar plates supplemented with 50 µg/ml Kanamycin and grown over night at 37° C. at a density yielding clearly visible single colonies. Cells were then scraped off the surface of these plates, washed with fresh LB medium and stored in aliquots for library screening at −80° C.

Results

Libraries for frame selection. Two libraries (LSPn70 and LSPn300) were generated in the pMAL4.31 vector with sizes of approximately 70 and 300 bp, respectively. For each library, ligation and subsequent transformation of approximately 1 µg of pMAL4.31 plasmid DNA and 50 ng of fragmented genomic S. pneumoniae DNA yielded $4 \times 10^5$ to $2 \times 10^6$ clones after frame selection. To assess the randomness of the libraries, approximately 600 randomly chosen clones of LSPn70 were sequenced. The bioinformatic analysis showed that of these clones only very few were present more than once. Furthermore, it was shown that 90% of the clones fell in the size range between 25 and 100 bp with an average size of 52 bp (FIG. 2). Almost all sequences followed the 3n+1 rule, showing that all clones were properly frame selected.

Bacterial surface display libraries. The display of peptides on the surface of E. coli required the transfer of the inserts from the LSPn libraries from the frame selection vector pMAL4.31 to the display plasmids pMAL9.1 (LamB) or pHIE11 (FhuA). Genomic DNA fragments were excised by FseI and NotI restriction and ligation of 5 ng inserts with 0.1 µg plasmid DNA and subsequent transformation into DH5alpha cells resulted in $2-5 \times 10^6$ clones. The clones were scraped off the LB plates and frozen without further amplification.

Example 3

Identification of Highly Immunogenic Peptide Sequences from S. pneumoniae Using Bacterial Surface Displayed Genomic Libraries and Human Serum Experimental Procedures MACS screening. Approximately $2.5 \times 10^8$ cells from a given library were grown in 5 ml LB-medium supplemented with 50 µg/ml Kanamycin for 2 h at 37° C. Expression was induced by the addition of 1 mM IPTG for 30 min. Cells were washed twice with fresh LB medium and approximately $2 \times 10^7$ cells re-suspended in 100 µl LB medium and transferred to an Eppendorf tube.

10 µg of biotinylated, human IgGs purified from serum was added to the cells and the suspension incubated overnight at 4° C. with gentle shaking. 900 µl of LB medium was added, the suspension mixed and subsequently centrifuged for 10 min at 6,000 rpm at 4° C. (For IgA screens, 10 µg of purified IgAs were used and these captured with biotinylated anti-human-IgG secondary antibodies). Cells were washed once with 1 ml LB and then re-suspended in 100 µl LB medium. 10 µl of MACS microbeads coupled to streptavidin (Miltenyi Biotech, Germany) were added and the incubation continued for 20 min at 4° C. Thereafter 900 µl of LB medium was added and the MACS microbead cell suspension was loaded onto the equilibrated MS column (Miltenyi Biotech, Germany) which was fixed to the magnet. (The MS columns were equilibrated by washing once with 1 ml 70% EtOH and twice with 2 ml LB medium.)

The column was then washed three times with 3 ml LB medium. After removal of the magnet, cells were eluted by washing with 2 ml LB medium. After washing the column with 3 ml LB medium, the 2 ml eluate was loaded a second time on the same column and the washing and elution process repeated. The loading, washing and elution process was performed a third time, resulting in a final eluate of 2 ml.

A second round of screening was performed as follows. The cells from the final eluate were collected by centrifugation and re-suspended in 1 ml LB medium supplemented with 50 µg/ml Kanamycin. The culture was incubated at 37° C. for 90 min and then induced with 1 mM IPTG for 30 min. Cells were subsequently collected, washed once with 1 ml LB medium and suspended in 10 µl LB medium. 10 µg of human, biotinylated IgGs were added again and the suspension incubated over night at 4° C. with gentle shaking. All further steps were exactly the same as in the first selection round. Cells selected after two rounds of selection were plated onto LB-agar plates supplemented with 50 µg/ml Kanamycin and grown over night at 37° C.

Evaluation of selected clones by sequencing and Western blot analysis. Selected clones were grown overnight at 37° C. in 3 ml LB medium supplemented with 50 µg/ml Kanamycin to prepare plasmid DNA using standard procedures. Sequencing was performed at MWG (Germany) or in collaboration with TIGR (U.S.A.).

For Western blot analysis approximately 10 to 20 µg of total cellular protein was separated by 10% SDS-PAGE and blotted onto HybondC membrane (Amersham Pharmacia Biotech, England). The LamB or FhuA fusion proteins were detected using human serum as the primary antibody at a dilution of approximately 1:5,000 and anti-human IgG or IgA antibodies coupled to HRP at a dilution of 1:5,000 as secondary antibodies. Detection was performed using the ECL detection kit (Amersham Pharmacia Biotech, England). Alternatively, rabbit anti-FhuA or rabbit anti-LamB polyclonal immune sera were used as primary antibodies in combination with the respective secondary antibodies coupled to HRP for the detection of the fusion proteins.

Results

Screening of bacterial surface display libraries by magnetic activated cell sorting (MACS) using biotinylated Igs. The libraries LSPn70 in pMAL9.1 and LSPn300 in pHIE11 were screened with pools of biotinylated, human IgGs and IgAs from patient sera or sera from healthy individuals (see Example 1: Preparation of antibodies from human serum). The selection procedure was performed as described under Experimental procedures. FIG. 3A shows a representative example of a screen with the LSPn-70 library and PSPn3-IgGs. As can be seen from the colony count after the first selection cycle from MACS screening, the total number of cells recovered at the end is drastically reduced from $2 \times 10^7$ cells to approximately $5 \times 10^4$ cells, whereas the selection without antibodies added showed a reduction to about $2 \times 10^3$ cells (FIG. 3A). After the second round, a similar number of cells was recovered with PSPn3-IgGs, while fewer than 10 cells were recovered when no IgGs from human serum were added, clearly showing that selection was dependent on S. pneumoniae specific antibodies. To evaluate the performance of the screen, 26 selected clones were picked randomly and subjected to immunoblot analysis with screening IgG pool (PSPn7) (FIG. 3B). This analysis revealed that ~90% of the selected clones showed reactivity with antibodies present in the relevant serum whereas the control strain expressing LamB without a S. pneumoniae specific insert did not react with the same serum. In general, the rate of reactivity was observed to lie within the range of 35 to 90%. Colony PCR analysis showed that all selected clones contained an insert in the expected size range.

Subsequent sequencing of a larger number of randomly picked clones (600 to 1200 per screen) led to the identification of the gene and the corresponding peptide or protein sequence that was specifically recognized by the human serum antibodies used for screening. The frequency with which a specific clone is selected reflects at least in part the abundance and/or affinity of the specific antibodies in the serum used for selection and recognizing the epitope presented by this clone. In that regard it is striking that clones derived from some ORFs (e.g. SP2216, SP0117, SP0641, SP2136, SP2190, SP0107, SP0082) were picked more than 100 times, indicating their highly immunogenic property. Table 1 summarizes the data obtained for all 12 performed screens. All clones that are presented in Table 1 have been verified by immunoblot analysis using whole cellular extracts from single clones to show the indicated reactivity with the pool of human serum used in the respective screen. As can be seen from Table 1, distinct regions of the identified ORF are identified as immunogenic, since variably sized fragments of the proteins are displayed on the surface by the platform proteins.

It is further worth noticing that most of the genes identified by the bacterial surface display screen encode proteins that are either attached to the surface of S. pneumoniae and/or are secreted. This is in accordance with the expected role of surface attached or secreted proteins in virulence of S. pneumoniae.

Example 4

Assessment of the Reactivity of Highly Immunogenic Peptide Sequences with Individual Human Sera Experimental Procedures Peptide Synthesis Peptides were synthesized in small scale (4 mg resin; up to 288 in parallel) using standard F-moc chemistry on a Rink amide resin (PepChem, Tübingen, Germany) using a SyroII synthesizer (Multisyntech, Witten, Germany). After the sequence was assembled, peptides were elongated with Fmoc-epsilon-aminohexanoic acid (as a linker) and biotin (Sigma, St. Louis, Mo.; activated like a normal amino acid). Peptides were cleaved off the resin with 93% TFA, 5% triethylsilane, and 2% water for one hour. Peptides were dried under vacuum and freeze dried three times from acetonitrile/water (1:1). The presence of the correct mass was verified by mass spectrometry on a Reflex III MALDI-TOF (Bruker, Bremen Germany). The peptides were used without further purification.

Enzyme Linked Immune Assay (ELISA).

Biotin-labeled peptides (at the N-terminus) were coated on Streptavidin ELISA plates (EXICON) at 10 µg/ml concentration according to the manufacturer's instructions. Highly specific Horse Radish Peroxidase (HRP)-conjugated anti-human IgG secondary antibodies (Southern Biotech) were used according to the manufacturers' recommendations (dilution: 1,000×). Sera were tested at two serum dilutions, 200× and 1,000×. Following manual coating, peptide plates were processed and analyzed by the Gemini 160 ELISA robot (TECAN) with a built-in ELISA reader (GENIOS, TECAN).

Approximately 110 patients and 60 healthy adult sera were included in the analysis. Following the bioinformatic analysis of selected clones, corresponding peptides were designed and synthesized. In case of epitopes with more than 26 amino acid residues, overlapping peptides were made. All peptides were synthesized with a N-terminal biotin-tag and used as coating reagents on Streptavidin-coated ELISA plates.

The analysis was performed in two steps. First, peptides were selected based on their reactivity with the individual sera, which were included in the serum pools used for preparations of IgG and IgA screening reagents for bacterial surface display. A summary for serum reactivity of 224 peptides representing *S. pneumoniae* epitopes from the genomic screen analysed with 20 human sera (representing 4 different pools of five sera) used for the antigen identification is shown in Table 2. The peptides were compared by the score calculated for each peptide based on the number of positive sera and the extent of reactivity. Peptides range from highly and widely reactive to weakly positive ones. Among the most reactive ones there are known antigens, some of them are also protective in animal challenge models for nasopharyngeal carriage or sepsis (e.g. PspA/SP0117, serine protease/ SP0641, histidine triad protein/SP1175). Peptides not displaying a positive reaction were not included in further, more detailed studies.

Second, a large number of not pre-selected individual sera from patients with invasive pneumococcal disease or from healthy adults and children were tested against the peptides showing specific and high reactivity with the screening sera. Seroconversion during disease was tested for highly positive peptides by using three serial serum samples collected longitudinally from patients with invasive pneumococcal disease, the first before disease occurred (pre), the second in the acute phase (within 5 days after onset) and the third in the convalescent phase (>3 weeks after onset) of the disease. Two representative ELISA experiments are shown with two different patients, displaying seroconversion to multiple peptides, suggesting that epitope-specific antibody levels were low before disease occurred, and were induced in the acute and convalescent phase (FIG. 5). The antigens showing this antibody profile are especially valuable for vaccine development (e.g. SP2216, SP2109, SP1175, SP0117, SP0082).

Example 5

Gene Distribution Studies with Highly Immunogenic Proteins Identified from *S. pneumoniae*

Experimental Procedures

Gene distribution of pneumococcal antigens by PCR. An ideal vaccine antigen would be an antigen that is present in all, or the vast majority of strains of the target organism to which the vaccine is directed. In order to establish whether the genes encoding the identified *Streptococcus pneumoniae* antigens occur ubiquitously in *S. pneumoniae* strains, PCR was performed on a series of independent *S. pneumoniae* isolates with primers specific for the gene of interest. *S. pneumoniae* isolates were obtained covering the serotypes most frequently present in patients as shown in FIG. 4A. Oligonucleotide sequences as primers were designed for all identified ORFs yielding products of approximately 1,000 bp, if possible covering all identified immunogenic epitopes. Genomic DNA of all *S. pneumoniae* strains was prepared as described under Example 2. PCR was performed in a reaction volume of 25 µl using Taq polymerase (1 U), 200 nM dNTPs, 10 pMol of each oligonucleotide and the kit according to the manufacturers instructions (Invitrogen, The Netherlands). As standard, 30 cycles (1×: 5 min. 95° C., 30×: 30 sec. 95° C., 30 sec. 56° C., 30 sec. 72° C., 1× 4 min. 72° C.) were performed, unless conditions had to be adapted for individual primer pairs.

Results

All identified genes encoding immunogenic proteins were tested by PCR for their presence in 50 different strains of *S. pneumoniae* (FIG. 4A). As an example, FIG. 4B shows the PCR reaction for SP1604 with all indicated 50 strains. As clearly visible, the gene is present in all strains analysed. The PCR fragment from a type 14 strain was sequenced and showed that of 414 bp, 6 bp are different as compared to the *S. pneumoniae* type 4 strain, resulting in three amino acid difference between the two isolates.

From a total of 50 genes analysed, 31 were present in all strains tested, while 9 genes were absent in more than 10 of the tested 50 strains (Table 3). Several genes (SP0667, SP0930) showed variation in size and were not present in all strain isolates. Some genes showed variation in size, but were otherwise conserved in all tested strains. Sequencing of the generated PCR fragment from one strain and subsequent comparison to the type 4 strain confirmed the amplification of the correct DNA fragment and revealed a degree of sequence divergence as indicated in Table 3 Importantly, many of the identified antigens are well conserved in all strains in sequence and size and are therefore novel vaccine candidates to prevent infections by pneumococci.

Example 6

Characterization of Immune Sera Obtained from Mice Immunized with Highly Immunogenic Proteins/Peptides from *S. pneumoniae* Displayed on the Surface of *E. coli*

Experimental Procedures

Generation of Immune Sera from Mice

*E. coli* clones harboring plasmids encoding the platform protein fused to a *S. pneumoniae* peptide, were grown in LB medium supplemented with 50 µg/ml Kanamycin at 37° C. Overnight cultures were diluted 1:10, grown until an $OD_{600}$ of 0.5 and induced with 0.2 mM IPTG for 2 hours. Pelleted bacterial cells were suspended in PBS buffer and disrupted by sonication on ice, generating a crude cell extract. According to the $OD_{600}$ measurement, an aliquot corresponding to $5 \times 10^7$ cells was injected into NMRI mice i.v., followed by a boost after 2 weeks. Serum was taken 1 week after the second injection. Epitope specific antibody levels were measured by peptide ELISA.

In Vitro Expression of Antigens

Expression of antigens by in vitro grown *S. pneumoniae* serotype 4 was tested by immunoblotting. Different growth media and culture conditions were tested to detect the presence of antigens in total lysates and bacterial culture supernatants. Expression was considered confirmed when a specific band corresponding to the predicted molecular weight and electrophoretic mobility was detected.

Cell Surface Staining

Flow cytometric analysis was carried out as follows. Bacteria were grown under culture conditions, which resulted in expression of the antigen as shown by the immunoblot analysis. Cells were washed twice in Hanks Balanced Salt Solution (HBSS) and the cell density was adjusted to approximately $1 \times 10^6$ CFU in 100 µl HBSS, 0.5% BSA. After incubation for 30 to 60 min at 4° C. with mouse antisera diluted 50 to 100-fold, unbound antibodies were washed away by centrifugation in excess HBSS, 0.5% BSA. Secondary goat antimouse antibody (F(ab')$_2$ fragment specific) labeled with fluorescein (FITC) was incubated with the cells at 4° C. for 30 to 60 min After washing, cells were fixed with 2% paraformaldehyde. Bound antibodies were detected using a Becton Dickinson FACScan flow cytometer and data further analyzed with the computer program CELLQuest. Negative control sera included mouse pre-immune serum and mouse polyclonal serum generated with lysates prepared from IPTG induced *E. coli* cells transformed with plasmids encoding the genes lamB or fhuA without *S. pneumoniae* genomic insert.

Bactericidal (Killing) Assay

Murine macrophage cells (RAW246.7 or P388.D1) and bacteria were incubated and the loss of viable bacteria after 60 min was determined by colony counting. In brief, bacteria were washed twice in Hanks Balanced Salt Solution (HBSS) and the cell density was adjusted to approximately $1 \times 10^5$ CFU in 50 µl HBSS. Bacteria were incubated with mouse sera (up to 25%) and guinea pig complement (up to 5%) in a total volume of 100 µl for 60 min at 4° C. Pre-opsonized bacteria were mixed with macrophages (murine cell line RAW264.7 or P388.D1; $2 \times 10^6$ cells per 100 µl) at a 1:20 ratio and were incubated at 37° C. on a rotating shaker at 500 rpm. An aliquot of each sample was diluted in sterile water and incubated for 5 min at room temperature to lyse macrophages. Serial dilutions were then plated onto Todd-Hewitt Broth agar plates. The plates were incubated overnight at 37° C., and the colonies were counted with the Countermat flash colony counter (IUL Instruments). Control sera included mouse pre-immune serum and mouse polyclonal serum generated with lysates prepared from IPTG induced E. coli transformed with plasmids harboring the genes lamB or fhuA without S. pneumoniae genomic insert.

Results

In vitro expression of antigens. The expression of the antigenic proteins was analyzed in vitro in S. pneumoniae serotype 4 by using sera raised against E. coli clones harboring plasmids encoding the platform protein fused to a S. pneumoniae peptide. First, the presence of specific antibodies was determined by peptide ELISA and/or immunoblotting using the E. coli clone expressing the given epitope embedded in LamB or FhuA platform proteins. Positive sera were then analysed by immunoblotting using total bacterial lysates and culture supernatants prepared from S. pneumoniae serotype 4 strain (data not shown). This analysis served as a first step to determine whether a protein is expressed at all, and if, under which growth conditions, in order to evaluate surface expression of the polypeptide by FACS analysis. It was anticipated based on literature data that not all proteins would be expressed under in vitro conditions.

Cell surface staining of S. pneumoniae. Cell surface accessibility for several antigenic proteins was subsequently demonstrated by an assay based on flow cytometry. Streptococci were incubated with preimmune and polyclonal mouse sera raised against S. pneumoniae lysate or E. coli clones harboring plasmids encoding the platform protein fused to a S. pneumoniae peptide, follow by detection with fluorescently tagged secondary antibody. As shown in FIG. 6A, antisera raised against S. pneumoniae lysate contains antibodies against surface components, demonstrated by a significant shift in fluorescence of the S. pneumoniae serotype 4 cell population. Similar cell surface staining of S. pneumoniae serotype 4 cells was observed with polyclonal sera raised against peptides of many of the pneumococcal antigens identified (FIG. 6B and Table 4.). In some instances, a subpopulation of the bacteria was not stained, as indicated by the detection of two peaks in the histograms (FIG. 6B). This phenomenon may be a result of differential expression of the gene products during the growth of the bacterium, insufficient antibody levels or partial inhibition of antibody binding caused by other surface molecules or plasma proteins.

In vitro bactericidal activity. Opsonophagocytic killing is the cornerstone of host defense against extracellular bacteria, such as S. pneumoniae. Cell surface binding of antibodies to bacterial antigens are opsonizing and induce killing (bactericidal) by phagocytic cells (macrophages and neutrophil granulocytes) if the antibodies induced by the particular antigens can bind activated complement components (C3bi). It has been shown that anti-pneumococcal bactericidal activity of human sera measured in in vitro assays can be correlated with in vivo protection of vaccinated individuals {Romero-Steiner, S. et al., 1999}. In FIG. 7 examples are shown and in Table 4 a summary is presented on bactericidal activity measured by antigen-specific antibodies generated in mice with corresponding epitopes. According to these data, several of the novel pneumococcal antigens induce functional antibodies (e.g. SP0082, SP2216, SP2136, SP0454, SP0069, SP0369, etc.). Importantly, a well-known protective pneumoniae antigen, PspA (SP0117) is proved to be strongly positive in the very same assay.

These experiments confirmed the bioinformatic prediction that many of the proteins are exported due to their signal peptide sequence and in addition showed that they are present on the cell surface of S. pneumoniae serotype 4. They also confirm that these proteins are available for recognition by human antibodies with functional properties and make them valuable candidates for the development of a vaccine against pneumococcal diseases.

Example 7

Identification of Pneumococcal Antigens Inducing Protective Immune Responses

Experimental Procedures

Expression of Recombinant Pneumococcal Proteins

Cloning of genes/DNA fragments: The gene/DNA fragment of interest was amplified from the genomic DNA of S pneumoniae (strain T4, Capsular type 4) by PCR using gene specific primers. Apart from the gene specific part, the primers had restriction sites that aided in a directional cloning of the amplified PCR product. The gene annealing (specific) part of the primer ranged between 15-24 bases in length. The PCR products obtained were digested with the appropriate restriction enzyme and cloned into pET28b(+) vector (NOVAGEN). Once the recombinant plasmid was confirmed to contain the gene of interest, E coli BL21 Star® cells (INVITROGEN) that served as expression hosts were transformed. These cells were optimized to efficiently express the gene of interest. Expression and purification of proteins: E coli BL21 Star®cells harbouring the recombinant plasmid was grown until log phase in a required culture volume. Once the $OD_{600nm}$ of 0.8 was reached the culture was induced with 1 mM IPTG for 3 hours at 37° C. The cells were harvested by centrifugation, lysed by a combination of freeze-thaw method followed by disruption of cells with 'Bug-Buster®, NOVAGEN'. The lysate was separated by centrifugation into soluble (supernatant) and insoluble (pellet) fractions. Depending on the location of the protein different purification strategies was followed. In case the protein was in the soluble fraction, purification of the protein was done by binding the above supernatant with Ni-Agarose beads (Ni-NTA-Agarose®, QIAGEN). Due to the presence of the penta Histidine (HIS) at the C or N or both termini of the expressed protein, it bound to the Ni-agarose while the other contaminating proteins were washed from the column by wash buffer. The proteins were eluted by 100 mM immidazole and the eluate was concentrated, assayed by Bradford for protein concentration and checked by PAGE and Western blot. In case the protein was present in the insoluble fraction the pellet was solubilized in buffer containing 8 M Urea. The purification was done under denaturing conditions (in buffer containing 8M Urea) using the same materials and procedure as mentioned above. The eluate was concentrated and dialyzed to remove all the urea in a gradual stepwise manner. The proteins were checked by SDS-PAGE and concentrations measured by Bradford method.

Animal Protection Studies

Animals: C3H (HeNHsd; A, B, C, D: agouti, wild type, inbred) female mice were used. Active immunization: 50 µg of recombinant proteins were injected subcutaneously and adjuvanted with Complete Freud Adjuvant (CFA). Animals were boosted twice with the same amount of protein, but adjuvanted with Incomplete Freund Adjuvant (IFA) at days 14 and 28. A well-known protective antigen PspA (SP0117) was used as a positive control, while nonimmunized (PBS or CFA/IFA adjuvant injected) mice served as negative controls. Antibody titers were measured at days 35-38 by ELISA using the respective recombinant proteins, and were determined to be in the range of 200.00-1.000.000 (end-point titer). Passive immunization: Näive mice were injected with 150-300 µl mouse sera intraperitoneally 2 hrs before intraperitoneal inoculation with S. pneumoniae. Bacterial challenge: A frozen glycerol stock of S. pneumoniae serotype 6B was prepared and used for all experiments. The approximate estimated cell number was determined by OD600 nm measurements. In order to determine the real viable cell numbers present in the inoculum prepared from the frozen glycerol stock cultures, cfus were determined via plating using six serial dilutions. $10^4$-$10^8$ bacteria/mouse was injected either intravenously in the tail vein or intraperitoneally. Protective effect of immunizations was measured by monitoring survival rates for 2 to 3 weeks post-challenge and was expressed in % of total number of animals (10/group).

Results

In the present invention six different pneumococcal antigens identified by bacterial surface display were determined to have protective effect in a mouse sepsis/lethality model. The best levels of protection were achieved by immunization with recombinant antigens representing the SP2190, SP2216 and SP0667 protein, while SP0368, SP1732 and SP0498 displayed lower levels of protection (FIG. 8). The protective effect was mediated by antibodies as it has been demonstrated by passive serum transfer experiments (FIG. 9). Naïve mice receiving specific anti-SP2190 and anti-SP2216 antibodies were protected from death relative to mice from the negative control groups. Importantly, the combination of these antigens resulted in improved protection, as it has been shown in FIG. 9. Passive immunization with 150 µl immune serum generated either with recombinant SP2190 or with recombinant SP2216 (supplemented with 150 µl näive serum) resulted in lower survival rate compared to serum therapy with 100 µl each of specific antisera (supplemented with 100 µl näive serum). These experiments strongly support that combination of these antigens has beneficial effects in vaccination against pneumococcal diseases.

Since the antigens used for immunization were derived from a serotype 4 strain and the challenge strain was a serotype 6B, these experiments established that the antigens were cross-protective.

The SP2216, SP2190 and SP1732 recombinant proteins detected the highest levels of antibodies in sera of patients convalescing from invasive pneumococcal diseases, as well as in those of healthy individuals exposed to *Pneumococcus* (children in the household) (data not shown). The most frequently identified antigen in bacterial surface display screens was the SP2216 protein. It was a special interest to compare the protectivity of the subdomains of this protein selected (N-terminal amino acid sequences) or not selected (C-terminal amino acid sequences) by human antibodies (FIG. 10A). Upon immunization with the two different domains (expressed as recombinant antigens) it became evident that the immunogenic part of the SP2216 protein carried the protective potential, while the non-selected domain was ineffective and comparable to the negative control (FIG. 10B). Based on this experiment the epitopes detected by bacterial surface display identifies protective epitopes and regions of bacterial proteins and this information can be used for rational design of subunit vaccines based on the antigens described in the present invention.

Example 8

Determination of Sequence Conservation of Protective Antigens

Experimental Procedures

Immunoblotting

Total bacterial lysate and culture supernatant samples were prepared from in vitro grown S. pneumoniae strains. 60 (clinical isolates) representing 48 different serotypes were included in the study. Approximately 25 µg total protein/lane was separated by SDS-PAGE using the BioRad Mini-Protean 3 Cell electrophoresis system and proteins transferred to nitrocellulose membrane (ECL, Amersham Pharmacia). After overnight blocking in 5% milk, hyperimmune mouse sera generated by immunization with the recombinant proteins SP2216, SP1732 and SP2190 (and SP0117/PspA as internal control) derived from serotype 4 strain were added at 5,000× dilution, and HRPO labeled anti-mouse IgG was used for detection.

DNA Sequencing

The genes of SP1732, SP2190 and SP22126 were amplified from the genomic DNA of S. pneumoniae (serotype 4, 6B, 9V, 14, 18C, 19F and 23F) by PCR using a proofreading polymerase Expand (ROCHE). Gene specific primers, ranging between 27-31 bases in length, were used to amplify the entire open reading frames. The PCR products obtained were cloned into pCR®2.1-TOPO vector (Invitrogen). The recombinant plasmid DNA was purified using a QIAprep® miniprep kit (Qiagen) before the sequence was confirmed (MWG). In addition to the seven serotypes, the gene of SP2216 from other 41 different serotypes was amplified by PCR and the purified PCR products were sequenced.

Results

Identification of conserved antigens inducing antibodies that are cross-reactive with different clinical isolates is crucial for the development effective vaccines. It is especially relevant for protein-based vaccines targeting pneumococcal diseases, since more then 90 different serotypes of *Streptococcus pnuemoniae* (*Pneumococcus*) have been associated with human infections.

In a thorough analysis it was determined that the antibodies induced by SP2216, SP2190 and SP1732 all derived from a serotype 4 strain broadly cross-reacted with all the different serotypes tested in the immunoblot analysis (FIG. 11). Notably, the SP2190 antigen that showed variation in electrophoretic mobility (indicating different sizes) preserved the antibody reactivity strongly suggesting that immunodominant epitopes are conserved. In contrast, we detected lower cross-reactivity with anti-PspA antibodies that is in accordance with the known differences in immunogenic amino acid sequences of this antigen.

In order to directly address the question whether the identified protective antigens are conserved among the different serotypes of S. pneumoniae, DNA sequence analysis was performed on the SP2216, SP1732 and SP2190 genes. SP2216 and SP1732 are highly conserved, only few amino acid changes were detected. The SP2216 gene was sequenced from 47 different clinical isolates representing 47 different *S. pneumoniae* serotypes and only single amino acid exchanges were detected and only in 2 of the analysed strains (FIG. 12). In the SP1732 gene one or two amino acid exchanges were detected in the majority (in four of the six) of strains analysed (FIG. 13). The 2190 antigen showed a great variability in the amino acid sequences of the corresponding genes as it is shown in FIG. 14. The insertions and deletions makes it difficult to calculate an exact amino acid homology among the different SP2190 variants, but it can be estimated to be between approx. 60 and 90%. However, the amino acid identity was sufficient to induce cross-reactive and cross-protective antibodies based on the experiments presented in FIGS. 8,9 and 11.

REFERENCES

Adamou, J., et al. (2001). *Infect Immun* 69: 949-58.
Altschul, S., et al. (1990). *Journal of Molecular Biology* 215: 403-10.
Bennett, D., et al. (1995). *J Mol Recognit* 8: 52-8.
Brown, J., et al. (2001). *Infect Immun* 69: 6702-6.
Burnie, J., et al. (1998). *J Antimicrob Chemother* 41: 319-22.
Clackson, T., et al. (1991). *Nature* 352: 624-8.
Devereux, J., et al. (1984). *Nucleic acids research* 12: 387-95.
Di Guilmi, A., et al. (2002). *EMBO Rep* 3: 728-34.
Doherty, E., et al. (2001). *Annu Rev Biophys Biomol Struct* 30: 457-475.
Eisenbraun, M., et al. (1993). *DNA Cell Biol* 12: 791-7.
Epidemiology and Prevention of Vaccine-Preventable Diseases, 7th Edition-Second Printing (The Pink Book). The Pink Book is published by the Centers for Disease Control and Prevention, U.S. Department of Health and Human Services.
Etz, H., et al. (2001). *J Bacteriol* 183: 6924-35.
Ganz, T. (1999). *Science* 286: 420-421.
Georgiou, G. (1997). *Nature Biotechnology* 15: 29-34.
Gray, B., et al. (1979). *J Infect Dis* 140: 979-83.
Gray, B., et al. (1986). *Pediatr Infect Dis* 5: 201-7.
Hashemzadeh-Bonehi, L., et al. (1998). *Mol Microbiol* 30: 676-678.
Hausdorff, W., et al. (2001). *Lancet* 357: 950-2.
Heinje, von G. (1987) e.g. Sequence Analysis in Molecular Biology, Acedimic Press
Hemmer, B., et al. (1999). *Nat Med* 5: 1375-82.
Hoe, N., et al. (2001). *J Infect Dis* 183: 633-9.
Hornef, M., et al. (2002). *Nat Immunol* 3: 1033-40.
Hoskins, J., et al. (2001). *J Bacteriol* 183: 5709-17.
Hyde, T., et al. (2001). *JAMA* 286: 1857-62.
Jedrzejas, M. (2001). *Microbiol Mol Biol Rev* 65: 187-207.
Johanson, K., et al. (1995). *J Biol Chem* 270: 9459-71.
Jones, P., et al. (1986). *Nature* 321: 522-5.
Kajava, A., et al. (2000). *J Bacteriol* 182: 2163-9.
Kohler, G., et al. (1975). *Nature* 256: 495-7.
Kolaskar, A., et al. (1990). *FEBS Lett* 276: 172-4.
Lewin, A., et al. (2001). *Trends Mol Med* 7: 221-8.
Marks, J., et al. (1992). *Biotechnology (NY)* 10: 779-83.
McCafferty, J., et al. (1990). *Nature* 348: 552-4.
McCormick, A., et al. (2003). *Nat Med* 9: 424-30.
McDaniel, L., et al. (1991). *Infect Immun* 59: 222-8.
Navarre, W., et al. (1999). *Microbiol Mol Biol Rev* 63: 174-229.
Okano, H., et al. (1991). *J Neurochem* 56: 560-7.
Oligodeoxynucleotides as Antisense Inhibitors of Gene Expression; CRC Press, Boca Tation, Fla. (1988) for a description of these molecules
Orange, M., et al. (1993). *Pediatr Infect Dis J* 12: 244-6.
Pelton, S., et al. (2003). *Vaccine* 21: 1562-71.
Phillips-Quagliata, J., et al. (2000). *J Immunol* 165: 2544-55.
Rammensee, H., et al. (1999). *Immunogenetics* 50: 213-9.
Roche, H., et al. (2003). *Infect Immun* 71: 1033-41.
Romero-Steiner, S., et al. (1999). *Clin Infect Dis* 29: 281-8.
Rosenow, C., et al. (1997). *Mol Microbiol* 25: 819-29.
Seeger, C., et al. (1984). *Proc Natl Acad Sci USA* 81: 5849-52.
Shibuya, A., et al. (2000). *Nature Immunology* 1: 441-6.
Skerra, A. (1994). *Gene* 151: 131-5.
Talkington, D., et al. (1996). *Microb Pathog* 21: 17-22.
Tang, D., et al. (1992). *Nature* 356: 152-4.
Tempest, P., et al. (1991). *Biotechnology (NY)* 9: 266-71.
Tettelin, H., et al. (2001). *Science* 293: 498-506.
Tourdot, S., et al. (2000). *Eur J Immunol* 30: 3411-21.
Whitney, C., et al. (2000). *N Engl J Med* 343: 1917-24.
Wiley, J., et al. (1987) Current Protocols in Molecular Biology.
Wizemann, T., et al. (2001). *Infect Immun* 69: 1593-8.

TABLE 1

Immunogenic proteins identified by bacterial surface display.

| S. pneumoniae antigenic protein | Putative function (by homology) | predicted immunogenic aa** | No. of selected clones per ORF and screen | Location of identified immunogenic region (aa) | Seq. ID (DNA, Prot.) |
|---|---|---|---|---|---|
| SP0008 | hypothetical protein | 4-11, 35-64, 66-76, 101-108, 111-119 | G: 15 | 57-114 | 1, 145 |
| SP0032 | DNA polymerase I (polA) | 5-27, 32-64, 92-102, 107-113, 119-125, 133-139, 148-162, 177-187, 195-201, 207-214, 241-251, 254-269, 285-300, 302-309, 317-324, 332-357, 365-404, 411-425, 443-463, 470-477, 479-487, 506-512, 515-520, 532-547, 556-596, 603-610, 616-622, 624-629, 636-642, 646-665, 667-674, 687-692, 708-720, 734-739, 752-757, 798-820, 824-851, 856-865 | H: 39, I: 6, L: 2 | 732-763 | 2, 146 |
| SP0069 | Choline binding protein I | 14-21, 36-44, 49-66, 102-127, 162-167, 177-196 | G: 1, H: 2, I: 1, K: 44, L: 3, M: 1 | 45-109 145-172 | 3, 147 |

TABLE 1-continued

Immunogenic proteins identified by bacterial surface display.

| S. pneumoniae antigenic protein | Putative function (by homology) | predicted immunogenic aa** | No. of selected clones per ORF and screen | Location of identified immunogenic region (aa) | Seq. ID (DNA, Prot.) |
|---|---|---|---|---|---|
| SP0071 | immunoglobulin A1 protease (iga-1) | 17-35, 64-75, 81-92, 100-119, 125-172, 174-183, 214-222, 230-236, 273-282, 287-303, 310-315, 331-340, 392-398, 412-420, 480-505, 515-523, 525-546, 553-575, 592-598, 603-609, 617-625, 631-639, 644-651, 658-670, 681-687, 691-704, 709-716, 731-736, 739-744, 750-763, 774-780, 784-791, 799-805, 809-822, 859-870, 880-885, 907-916, 924-941, 943-949, 973-986, 1010-1016, 1026-1036, 1045-1054, 1057-1062, 1082-1088, 1095-1102, 1109-1120, 1127-1134, 1140-1146, 1152-1159, 1169-1179, 1187-1196, 1243-1251, 1262-1273, 1279-1292, 1306-1312, 1332-1343, 1348-1364, 1379-1390, 1412-1420, 1427-1436, 1458-1468, 1483-1503, 1524-1549, 1574-1588, 1614-1619, 1672-1685, 1697-1707, 1711-1720, 1738-1753, 1781-1787, 1796-1801, 1826-1843 | A: 3, C: 1, D: 9, E: 9, F: 4, G: 21, I: 34, K: 61, L: 20, M: 2 | 132-478 508-592 1753-1810 | 4, 148 |
| SP0082 | Cell wall surface anchor | 15-43, 49-55, 71-77, 104-110, 123-130, 162-171, 180-192, 199-205, 219-227, 246-254, 264-270, 279-287, 293-308, 312-322, 330-342, 349-356, 369-377, 384-394, 401-406, 416-422, 432-439, 450-460, 464-474, 482-494, 501-508, 521-529, 536-546, 553-558, 568-574, 584-591, 602-612, 616-626, 634-646, 653-660, 673-681, 688-698, 705-710, 720-726, 736-749, 833-848 | C: 9, E: 4, F: 2, I: 26, L: 4, M: 67 | 1-199 200-337 418-494 549-647 | 5, 149 |
| SP0107 | LysM domain protein | 9-30, 65-96, 99-123, 170-178 | A: 3, B: 16, C: 15, D: 1, E: 5, F: 178, M: 1 | 1-128 | 6, 150 |
| SP0117 | pneumococcal surface protein A (pspA) | 7-32, 34-41, 96-106, 127-136, 154-163, 188-199, 207-238, 272-279, 306-312, 318-325, 341-347, 353-360, 387-393, 399-406, 434-440, 452-503, 575-580, 589-601, 615-620, 635-640, 654-660, 674-680, 696-701, 710-731 | A: 13, B: 11, C: 10, D: 4, E: 31, F: 6, G: 33, H: 13, I: 9, K: 64, L: 32, M: 46 | 1-548 660-691 | 7, 151 |
| SP0191 | hypothetical protein | 4-19, 35-44, 48-59, 77-87, 93-99, 106-111, 130-138, 146-161 | E: 1, I: 2 | 78-84 | 8, 152 |
| SP0197 | dihydrofolate synthetase, putative | 24-30, 36-43, 64-86, 93-99, 106-130, 132-145, 148-165, 171-177, 189-220, 230-249, 251-263, 293-300, 302-312, 323-329, 338-356, 369-379, 390-412 | L: 9 | 179-193 | 9, 153 |
| SP0212 | Ribosomal protein L2 | 30-39, 61-67, 74-81, 90-120, 123-145, 154-167, 169-179, 182-197, 200-206, 238-244, 267-272 | L: 10 | 230-265 | 10, 154 |
| SP0222 | Ribosomal protein S14 | 14-20, 49-65, 77-86 | H: 14, L: 8, M: 3 | 2-68 | 11, 155 |
| SP0239 | Conserved hypothetical protein | 4-9, 26-35, 42-48, 53-61, 63-85, 90-101, 105-111, 113-121, 129-137, 140-150, 179-188, 199-226, 228-237, 248-255, 259-285, 299-308, 314-331, 337-343, 353-364, 410-421, 436-442 | L: 2, M: 1 | 110-144 | 12, 156 |
| SP0251 | formate acetyltransferase, putative | 36-47, 55-63, 94-108, 129-134, 144-158, 173-187, 196-206, 209-238, 251-266, 270-285, 290-295, 300-306, 333-344, 346-354, 366-397, 404-410, 422-435, 439-453, 466-473, 515-523, 529-543, 554-569, 571-585, 590-596, 607-618, 627-643, 690-696, 704-714, 720-728, 741-749, 752-767, 780-799 | G: 2, H: 7, I: 1, M: 5 | 225-247 480-507 | 13, 157 |

TABLE 1-continued

Immunogenic proteins identified by bacterial surface display.

| S. pneumoniae antigenic protein | Putative function (by homology) | predicted immunogenic aa** | No. of selected clones per ORF and screen | Location of identified immunogenic region (aa) | Seq. ID (DNA, Prot.) |
|---|---|---|---|---|---|
| SP0295 | ribosomal protein S9 (rpsI) | 16-25, 36-70, 80-93, 100-106 | I: 4 | 78-130 | 14, 158 |
| SP0330 | sugar binding transcriptional regulator RegR | 18-27, 41-46, 50-57, 65-71, 79-85, 93-98, 113-128, 144-155, 166-178, 181-188, 201-207, 242-262, 265-273, 281-295, 303-309, 318-327 | G: 1, H: 1, L: 4 | 36-64 | 15, 159 |
| SP0368 | cell wall surface anchor family protein | 7-29, 31-44, 50-59, 91-96, 146-153, 194-201, 207-212, 232-238, 264-278, 284-290, 296-302, 326-353, 360-370, 378-384, 400-405, 409-418, 420-435, 442-460, 499-506, 529-534, 556-562, 564-576, 644-651, 677-684, 687-698, 736-743, 759-766, 778-784, 808-814, 852-858, 874-896, 920-925, 929-935, 957-965, 1003-1012, 1021-1027, 1030-1044, 1081-1087, 1101-1111, 1116-1124, 1148-1159, 1188-1196, 1235-1251, 1288-1303, 1313-1319, 1328-1335, 1367-1373, 1431-1437, 1451-1458, 1479-1503, 1514-1521, 1530-1540, 1545-1552, 1561-1568, 1598-1605, 1617-1647, 1658-1665, 1670-1676, 1679-1689, 1698-1704, 1707-1713, 1732-1738, 1744-1764 | D: 1, H: 3, I: 1, L: 1, M: 3 | 1-70 154-189 922-941 1445-1462 1483-1496 | 16, 160 |
| SP0369 | Penicillin binding protein 1A | 6-51, 81-91, 104-113, 126-137, 150-159, 164-174, 197-209, 215-224, 229-235, 256-269, 276-282, 307-313, 317-348, 351-357, 376-397, 418-437, 454-464, 485-490, 498-509, 547-555, 574-586, 602-619 | B: 1, E: 1, L: 13, M: 1 | 452-530 | 17, 161 |
| SP0374 | hypothetical protein | 25-31, 39-47, 49-56, 99-114, 121-127, 159-186, 228-240, 253-269, 271-279, 303-315, 365-382, 395-405, 414-425, 438-453 | E: 4, I: 1, L: 3 | 289-384 | 18, 162 |
| SP0377 | Choline binding protein C | 9-24, 41-47, 49-54, 68-78, 108-114, 117-122, 132-140, 164-169, 179-186, 193-199, 206-213, 244-251, 267-274, 289-294, 309-314, 327-333 | G: 5, H: 4, I: 1, K: 88, L: 3, M: 8 | 209-249 286-336 | 19, 163 |
| SP0378 | choline binding protein J (cbpJ) | 9-28, 53-67, 69-82, 87-93, 109-117, 172-177, 201-207, 220-227, 242-247, 262-268, 305-318, 320-325 | K: 47, L: 6, M: 5 | 286-306 | 20, 164 |
| SP0390 | choline binding protein G (cbpG) | 4-10, 26-39, 47-58, 63-73, 86-96, 98-108, 115-123, 137-143, 148-155, 160-176, 184-189, 194-204, 235-240, 254-259, 272-278 | G: 1, K: 69, M: 6 | 199-283 | 21, 165 |
| SP0454 | hypothetical protein | 4-26, 33-39, 47-53, 59-65, 76-83, 91-97, 104-112, 118-137, 155-160, 167-174, 198-207, 242-268, 273-279, 292-315, 320-332, 345-354, 358-367, 377-394, 403-410, 424-439, 445-451, 453-497, 511-518, 535-570, 573-589, 592-601, 604-610 | H: 1, I: 1, L: 6 | 202-242 | 22, 166 |
| SP0463 | cell wall surface anchor family protein | 8-30, 36-45, 64-71, 76-82, 97-103, 105-112, 134-151, 161-183, 211-234, 253-268, 270-276, 278-284, 297-305, 309-315, 357-362, 366-372, 375-384, 401-407, 409-416, 441-455, 463-470, 475-480, 490-497, 501-513, 524-537, 552-559, 565-576, 581-590, 592-600, 619-625, 636-644, 646-656 | A: 1, B: 2, C: 4, E: 1, F: 4, | 316-419 | 23, 167 |
| SP0466 | sortase, putative | 4-17, 52-58, 84-99, 102-110, 114-120, 124-135, 143-158, 160-173, 177-196, 201-216, 223-250, 259-267, 269-275 | E: 1, M: 2 | 1-67 | 24, 168 |
| SP0468 | Sortase, putative | 6-46, 57-67, 69-80, 82-133, 137-143, 147-168, 182-187, 203-209, 214-229, 233-242, 246-280 | G: 24, H: 20, L: 1 | 53-93 | 25, 169 |
| SP0498 | endo-beta-N-acetylglucosaminidase, putative | 7-40, 50-56, 81-89, 117-123, 202-209, 213-218, 223-229, 248-261, 264-276, 281-288, 303-308, 313-324, 326-332, 340-346, 353-372, 434-443, 465-474, 514-523, 556-564, 605-616, 620-626, 631-636, 667-683, 685-699, 710-719, | B: 5, C: 1, E: 2, F: 1, G: 2 | 1226-1309 1455-1536 1538-1605 | 26, 170 |

TABLE 1-continued

Immunogenic proteins identified by bacterial surface display.

| S. pneumoniae antigenic protein | Putative function (by homology) | predicted immunogenic aa** | No. of selected clones per ORF and screen | Location of identified immunogenic region (aa) | Seq. ID (DNA, Prot.) |
|---|---|---|---|---|---|
| | | 726-732, 751-756, 760-771, 779-788, 815-828, 855-867, 869-879, 897-902, 917-924, 926-931, 936-942, 981-1000, 1006-1015, 1017-1028, 1030-1039, 1046-1054, 1060-1066, 1083-1092, 1099-1112, 1122-1130, 1132-1140, 1148-1158, 1161-1171, 1174-1181, 1209-1230, 1236-1244, 1248-1254, 1256-1267, 1269-1276, 1294-1299, 1316-1328, 1332-1354, 1359-1372, 1374-1380, 1384-1390, 1395-1408, 1419-1425, 1434-1446, 1453-1460, 1465-1471, 1474-1493, 1505-1515, 1523-1537, 1547-1555, 1560-1567, 1577-1605, 1633-1651 | | | |
| SP0509 | type I restriction-modification system, M subunit | 4-10, 31-39, 81-88, 106-112, 122-135, 152-158, 177-184, 191-197, 221-227, 230-246, 249-255, 303-311, 317-326, 337-344, 346-362, 365-371, 430-437, 439-446, 453-462, 474-484 | I: 2 | 449-467 | 27, 171 |
| SP0519 | dnaJ protein (dnaJ) | 9-15, 24-35, 47-55, 122-128, 160-177, 188-196, 202-208, 216-228, 250-261, 272-303, 318-324, 327-339, 346-352, 355-361, 368-373 | A: 1, D: 2, H: 2 | 108-218 344-376 | 28, 172 |
| SP0529 | BlpC ABC transporter (blpB) | 6-14, 17-48, 55-63, 71-90, 99-109, 116-124, 181-189, 212-223, 232-268, 270-294, 297-304, 319-325, 340-348, 351-370, 372-378, 388-394, 406-415, 421-434 | A: 1, B: 3, C: 3, D: 1, F: 4, | 177-277 | 29, 173 |
| SP0564 | hypothetical protein | 21-39, 42-61, 65-75, 79-85, 108-115 | H: 3 | 11-38 | 30, 174 |
| SP0609 | amino acid ABC transporter, amino acid-binding protein | 4-17, 26-39, 61-76, 103-113, 115-122, 136-142, 158-192, 197-203, 208-214, 225-230, 237-251 | I: 3 | 207-225 | 31, 175 |
| SP0613 | metallo-beta-lactamase superfamily protein | 5-11, 27-36, 42-53, 62-70, 74-93, 95-104, 114-119, 127-150, 153-159, 173-179, 184-193, 199-206, 222-241, 248-253, 257-280, 289-295, 313-319, 322-342, 349-365, 368-389, 393-406, 408-413, 426-438, 447-461, 463-470, 476-495, 532-537, 543-550 | I: 12 | 225-246 | 32, 176 |
| SP0641 | Serine protease | 4-29, 68-82, 123-130, 141-147, 149-157, 178-191, 203-215, 269-277, 300-307, 327-335, 359-370, 374-380, 382-388, 393-400, 410-417, 434-442, 483-492, 497-503, 505-513, 533-540, 564-569, 601-607, 639-647, 655-666, 693-706, 712-718, 726-736, 752-758, 763-771 774-780, 786-799, 806-812, 820-828, 852-863, 884-892, 901-909, 925-932, 943-948, 990-996, 1030-1036, 1051-1059, 1062-1068, 1079-1086, 1105-1113, 1152-1162, 1168-1179, 1183-1191, 1204-1210, 1234-1244, 1286-1295, 1318-1326, 1396-1401, 1451-1460, 1465-1474, 1477-1483, 1488-1494, 1505-1510, 1514-1521, 1552-1565, 1593-1614, 1664-1672, 1677-1685, 1701-1711, 1734-1745, 1758-1770, 1784-1798, 1840-1847, 1852-1873, 1885-1891, 1906-1911, 1931-1939, 1957-1970, 1977-1992, 2014-2020, 2026-2032, 2116-2134 | A: 19, B: 72, C: 34, D: 5, E: 21, F: 86, G: 26, H: 86, I: 17, L: 130, M: 29 | 1-348 373-490 573-767 903-1043 1155-1198 1243-1482 1550-1595 1682-1719 1793-1921 2008-2110 | 33, 177 |
| SP0648 | beta-galactosidase (bgaA) | 10-35, 39-52, 107-112, 181-188, 226-236, 238-253, 258-268, 275-284, 296-310, 326-338, 345-368, 380-389, 391-408, 410-418, 420-429, 444-456, 489-505, 573-588, 616-623, 637-643, 726-739, 741-767, 785-791, 793-803, 830-847, 867-881, 886-922, 949-956, 961-980, 988-1004, 1009-1018, 1027-1042, 1051-1069, 1076-1089, 1108-1115, 1123-1135, 1140-1151, 1164-1179, | C: 1, E: 1, F: 1, G: 1, H: 4, I: 1, M: 2 | 1526-1560 | 34, 178 |

TABLE 1-continued

Immunogenic proteins identified by bacterial surface display.

| S. pneumoniae antigenic protein | Putative function (by homology) | predicted immunogenic aa** | No. of selected clones per ORF and screen | Location of identified immunogenic region (aa) | Seq. ID (DNA, Prot.) |
|---|---|---|---|---|---|
| | | 1182-1191, 1210-1221, 1223-1234, 1242-1250, 1255-1267, 1281-1292, 1301-1307, 1315-1340, 1348-1355, 1366-1373, 1381-1413, 1417-1428, 1437-1444, 1453-1463, 1478-1484, 1490-1496, 1498-1503, 1520-1536, 1538-1546, 1548-1570, 1593-1603, 1612-1625, 1635-1649, 1654-1660, 1670-1687, 1693-1700, 1705-1711, 1718-1726, 1729-1763, 1790-1813, 1871-1881, 1893-1900, 1907-1935, 1962-1970, 1992-2000, 2006-2013, 2033-2039, 2045-2051, 2055-2067, 2070-2095, 2097-2110, 2115-2121, 2150-2171, 2174-2180, 2197-2202, 2206-2228 | | | |
| SP0664 | Zinc metalloprotease ZmpB, putative | 4-17, 35-48, 54-76, 78-107, 109-115, 118-127, 134-140, 145-156, 169-174, 217-226, 232-240, 256-262, 267-273, 316-328, 340-346, 353-360, 402-409, 416-439, 448-456, 506-531, 540-546, 570-578, 586-593, 595-600, 623-632, 662-667, 674-681, 689-705, 713-724, 730-740, 757-763, 773-778, 783-796, 829-835, 861-871, 888-899, 907-939, 941-955, 957-969, 986-1000, 1022-1028, 1036-1044, 1068-1084, 1095-1102, 1118-1124, 1140-1146, 1148-1154, 1168-1181, 1185-1190, 1197-1207, 1218-1226, 1250-1270, 1272-1281, 1284-1296, 1312-1319, 1351-1358, 1383-1409, 1422-1428, 1438-1447, 1449-1461, 1482-1489, 1504-1510, 1518-1527, 1529-1537, 1544-1551, 1569-1575, 1622-1628, 1631-1637, 1682-1689, 1711-1718, 1733-1740, 1772-1783, 1818-1834, 1859-1872 | A: 9, B: 25, C: 13, D: 7, E: 14, F: 77, G: 12, H: 10, K: 67, L: 13, M: 6 | 1-64 128-495 | 35, 179 |
| SP0667 | pneumococcal surface protein, putative | 8-28, 32-37, 62-69, 119-125, 137-149, 159-164, 173-189, 200-205, 221-229, 240-245, 258-265, 268-276, 287-293, 296-302, 323-329 | A: 72, B: 80, C: 90, D: 20, E: 12, F: 53 | 1-95 | 36, 180 |
| SP0688 | UDP-N-acetylmuramoyl alanine--D-glutamate ligase | 9-18, 25-38, 49-63, 65-72, 74-81, 94-117, 131-137, 139-146, 149-158, 162-188, 191-207, 217-225, 237-252, 255-269, 281-293, 301-326, 332-342, 347-354, 363-370, 373-380, 391-400, 415-424, 441-447 | I: 3 | 75-107 | 37, 181 |
| SP0749 | branched-chain amino acid ABC transporter | 4-24, 64-71, 81-87, 96-116, 121-128, 130-139, 148-155, 166-173, 176-184, 203-215, 231-238, 243-248, 256-261, 280-286, 288-306, 314-329 | E: 2, I: 8, L: 8 | 67-148 | 38, 182 |
| SP0770 | ABC transporter, ATP-binding protein | 4-10, 19-37, 46-52, 62-81, 83-89, 115-120, 134-139, 141-151, 168-186, 197-205, 209-234, 241-252, 322-335, 339-345, 363-379, 385-393, 403-431, 434-442, 447-454, 459-465, 479-484, 487-496 | L: 2 | 404-420 | 39, 183 |
| SP0785 | conserved hypothetical protein | 10-35, 46-66, 71-77, 84-93, 96-122, 138-148, 154-172, 182-213, 221-233, 245-263, 269-275, 295-301, 303-309, 311-320, 324-336, 340-348, 351-359, 375-381 | C: 1, E: 2, I: 1 | 111-198 | 40, 184 |
| SP0914 | nodulin-related protein, truncation | 14-25, 30-42, 47-61, 67-75, 81-91, 98-106, 114-122, 124-135, 148-193, 209-227 | L.2 | 198-213 | 41, 185 |
| SP0930 | choline binding protein E (cbpE) | 5-18, 45-50, 82-90, 97-114, 116-136, 153-161, 163-171, 212-219, 221-227, 240-249, 267-281, 311-317, 328-337, 375-381, 390-395, 430-436, 449-455, 484-495, 538-543, 548-554, 556-564, 580-586, 596-602 | E: 4, G: 2, H: 1, I: 2, K: 5 | 493-606 | 42, 186 |

TABLE 1-continued

Immunogenic proteins identified by bacterial surface display.

| S. pneumoniae antigenic protein | Putative function (by homology) | predicted immunogenic aa** | No. of selected clones per ORF and screen | Location of identified immunogenic region (aa) | Seq. ID (DNA, Prot.) |
|---|---|---|---|---|---|
| SP0943 | Gid protein (gid) | 9-25, 28-34, 37-44, 61-68, 75-81, 88-96, 98-111, 119-133, 138-150, 152-163, 168-182, 186-194, 200-205, 216-223, 236-245, 257-264, 279-287, 293-304, 311-318, 325-330, 340-346, 353-358, 365-379, 399-409, 444-453 | E: 2, L: 24 | 303-391 | 43, 187 |
| SP0952 | alanine dehydrogenase, authentic frameshift (ald) | 16-36, 55-61, 66-76, 78-102, 121-130, 134-146, 150-212, 221-239, 255-276, 289-322, 329-357 | G: 3, H: 4 | 29-59 | 44, 188 |
| SP1003 | conserved hypothetical protein (PAT) | 8-27, 68-74, 77-99, 110-116, 124-141, 171-177, 202-217, 221-228, 259-265, 275-290, 293-303, 309-325, 335-343, 345-351, 365-379, 384-394, 406-414, 423-437, 452-465, 478-507, 525-534, 554-560, 611-624, 628-651, 669-682, 742-747, 767-778, 782-792, 804-812, 820-836 | A: 2, B: 5, C: 8, D: 5, E: 13, F: 3, M: 2 | 79-231 359-451 | 45, 189 |
| SP1004 | Conserved hypothetical protein | 5-28, 39-45, 56-62, 67-74, 77-99, 110-117, 124-141, 168-176, 200-230, 237-244, 268-279, 287-299, 304-326, 329-335, 348-362, 370-376, 379-384, 390-406, 420-429, 466-471, 479-489, 495-504, 529-541, 545-553, 561-577, 598-604, 622-630, 637-658, 672-680, 682-688, 690-696, 698-709, 712-719, 724-736, 738-746, 759-769, 780-786, 796-804, 813-818, 860-877, 895-904, 981-997, 1000-1014, 1021-1029 | A: 5, B: 4, C: 4, D: 9, E: 12, F: 4, H: 3, I: 1, L: 1 | 1-162 206-224 254-350 414-514 864-938 | 46, 190 |
| SP1124 | glycogen synthase (glgA) | 4-11, 19-49, 56-66, 68-101, 109-116, 123-145, 156-165, 177-185, 204-221, 226-234, 242-248, 251-256, 259-265, 282-302, 307-330, 340-349, 355-374, 377-383, 392-400, 422-428, 434-442, 462-474 | M: 1 | 266-322 | 47, 191 |
| SP1154 | IgA1 protease | 14-43, 45-57, 64-74, 80-87, 106-127, 131-142, 145-161, 173-180, 182-188, 203-210, 213-219, 221-243, 245-254, 304-311, 314-320, 342-348, 354-365, 372-378, 394-399, 407-431, 436-448, 459-465, 470-477, 484-490, 504-509, 531-537, 590-596, 611-617, 642-647, 723-734, 740-751, 754-762, 764-774, 782-797, 807-812, 824-831, 838-845, 877-885, 892-898, 900-906, 924-935, 940-946, 982-996, 1006-1016, 1033-1043, 1051-1056, 1058-1066, 1094-1108, 1119-1126, 1129-1140, 1150-1157, 1167-1174, 1176-1185, 1188-1201, 1209-1216, 1220-1228, 1231-1237, 1243-1248, 1253-1285, 1288-1297, 1299-1307, 1316-1334, 1336-1343, 1350-1359, 1365-1381, 1390-1396, 1412-1420, 1427-1439, 1452-1459, 1477-1484, 1493-1512, 1554-1559, 1570-1578, 1603-1608, 1623-1630, 1654-1659, 1672-1680, 1689-1696, 1705-1711, 1721-1738, 1752-1757, 1773-1780, 1817-1829, 1844-1851, 1856-1863, 1883-1895, 1950-1958, 1974-1990 | A: 6, B: 2, C: 9, D: 3, E: 4, F: 2, G: 6, H: 4, I: 13, L: 12 | 172-354 384-448 464-644 648-728 1357-1370 | 48, 192 |
| SP1174 | conserved domain protein (PAT) | 8-27, 68-74, 77-99, 110-116, 124-141, 169-176, 201-216, 220-227, 258-264, 274-289, 292-302, 308-324, 334-342, 344-350, 364-372, 377-387, 399-407, 416-429, 445-458, 471-481, 483-500, 518-527, 547-553, 604-617, 621-644, 662-675, 767-778, 809-816 | B: 14, C: 17, D: 6, E: 18, F: 16, I: 1, K: 5, L: 1, M: 8 | 15-307 350-448 496-620 | 49, 193 |
| SP1175 | conserved domain protein | 4-17, 24-29, 53-59, 62-84, 109-126, 159-164, 189-204, 208-219, 244-249, 274-290, 292-302, 308-324, 334-342, 344-350, 378-389, 391-397, 401-409, 424-432, | A: 1, B: 4, C: 3, D: 3, | 56-267 337-426 495-601 | 50, 194 |

TABLE 1-continued

Immunogenic proteins identified by bacterial surface display.

| S. pneumoniae antigenic protein | Putative function (by homology) | predicted immunogenic aa** | No. of selected clones per ORF and screen | Location of identified immunogenic region (aa) | Seq. ID (DNA, Prot.) |
|---|---|---|---|---|---|
| | | 447-460, 470-479, 490-504, 521-529, 538-544, 549-555, 570-577, 583-592, 602-608, 615-630, 635-647, 664-677, 692-698, 722-731, 733-751, 782-790, 793-799 | E: 9, F: 2, H: 2, M: 4 | | |
| SP1221 | type II restriction endonuclease | 12-22, 49-59, 77-89, 111-121, 136-148, 177-186, 207-213, 217-225, 227-253, 259-274, 296-302, 328-333, 343-354, 374-383, 424-446, 448-457, 468-480, 488-502, 507-522, 544-550, 553-560, 564-572, 587-596, 604-614, 619-625, 629-635, 638-656, 662-676, 680-692, 697-713, 720-738, 779-786, 833-847, 861-869, 880-895, 897-902, 911-917, 946-951, 959-967, 984-990, 992-1004, 1021-1040, 1057-1067, 1073-1080 | G: 2, H: 1, K: 1, L: 4 | 381-403 | 51, 195 |
| SP1227 | DNA-binding response regulator | 4-10, 26-31, 46-56, 60-66, 70-79, 86-94, 96-102, 109-118, 132-152, 164-187, 193-206, 217-224 | E: 1, L: 3 | 81-149 | 52, 196 |
| SP1241 | amino acid ABC transporter, amino acid-binding pro | 4-21, 26-37, 48-60, 71-82, 109-117, 120-128, 130-136, 142-147, 181-187, 203-211, 216-223, 247-255, 257-284, 316-325, 373-379, 395-400, 423-435, 448-456, 479-489, 512-576, 596-625, 641-678, 680-688, 692-715 | B: 2, C: 1, E: 2, I: 1 | 346-453 | 53, 197 |
| SP1287 | signal recognition particle protein (ffh) | 10-16, 25-31, 34-56, 58-69, 71-89, 94-110, 133-176, 186-193, 208-225, 240-250, 259-266, 302-307, 335-341, 376-383, 410-416 | B: 8, G: 8, H: 3, M: 1 | 316-407 | 54, 198 |
| SP1330 | N-acetylmannosamine-6-P epimerase, putative (nanE) | 11-29, 42-56, 60-75, 82-88, 95-110, 116-126, 132-143, 145-160, 166-172, 184-216 | L: 45 | 123-164 | 55, 199 |
| SP1374 | Chorismate sythetase (aroC) | 11-29, 54-63, 110-117, 139-152, 158-166, 172-180, 186-193, 215-236, 240-251, 302-323, 330-335, 340-347, 350-366, 374-381 | G: 1, L: 29, M: 14 | 252-299 | 56, 200 |
| SP1378 | conserved hypothetical protein | 18-27, 35-42, 50-56, 67-74, 112-136, 141-153, 163-171, 176-189, 205-213, 225-234, 241-247, 253-258, 269-281, 288-298, 306-324, 326-334, 355-369, 380-387 | H: 2 | 289-320 | 57, 201 |
| SP1429 | peptidase, U32 family | 7-15, 19-41, 56-72, 91-112, 114-122, 139-147, 163-183, 196-209, 258-280, 326-338, 357-363, 391-403, 406-416 | H: 4 | 360-378 | 58, 202 |
| SP1478 | oxidoreductase, aldo/keto reductase family | 11-18, 29-41, 43-49, 95-108, 142-194, 204-212, 216-242, 247-256, 264-273, | H: 11 | 136-149 | 59, 203 |
| SP1518 | conserved hypothetical protein | 18-24, 33-40, 65-79, 89-102, 113-119, 130-137, 155-161, 173-179, 183-203, 205-219, 223-231, 245-261, 267-274, 296-306, 311-321, 330-341, 344-363, 369-381, 401-408, 415-427, 437-444, 453-464, 472-478, 484-508, 517-524, 526-532, 543-548 | A: 10, E: 4, G: 5, H: 1 | 59-180 | 60, 204 |
| SP1522 | conserved domain protein | 5-13, 52-65, 67-73, 97-110, 112-119, 134-155 | B: 4, C: 6, E: 1, H: 7, L: 3 | 45-177 | 61, 205 |
| SP1527 | oligopeptide ABC transporter | 6-28, 34-43, 57-67, 75-81, 111-128, 132-147, 155-163, 165-176, 184-194, 208-216, 218-229, 239-252, 271-278, 328-334, 363-376, 381-388, 426-473, 481-488, 492-498, 507-513, 536-546, 564-582, 590-601, 607-623 | A: 1, B: 1, C: 4, F: 1, G: 26, H: 18, I: 10, L: 2, M: 1 | 148-269 420-450 610-648 | 62, 206 |
| SP1573 | lysozyme (lytC) | 4-12, 20-38, 69-75, 83-88, 123-128, 145-152, 154-161, 183-188, 200-213, 245-250, 266-272, 306-312, 332-339, 357-369, 383-389, 395-402, 437-453, 455-470, 497-503 | A: 40, B: 27, C: 24, D: 2, E: 6, G: 11, K: 1 | 1-112 | 63, 207 |
| SP1604 | hypothetical protein | 35-59, 74-86, 111-117, 122-137 | A: 1, C: 3, E: 1, G: 1, I: 1 | 70-154 | 64, 208 |

TABLE 1-continued

Immunogenic proteins identified by bacterial surface display.

| S. pneumoniae antigenic protein | Putative function (by homology) | predicted immunogenic aa** | No. of selected clones per ORF and screen | Location of identified immunogenic region (aa) | Seq. ID (DNA, Prot.) |
|---|---|---|---|---|---|
| SP1661 | cell division protein DivIVA | 26-42, 54-61, 65-75, 101-107, 123-130, 137-144, 148-156, 164-172, 177-192, 213-221, 231-258 | E: 2 | 157-249 | 65, 209 |
| SP1664 | ylmF protein (ylmF) | 29-38, 61-67, 77-87, 94-100, 105-111, 118-158 | B: 1, C: 42, I: 3 | 1-97 | 66, 210 |
| SP1676 | N-acetylneuraminate lyase, putative | 7-21, 30-48, 51-58, 60-85, 94-123, 134-156, 160-167, 169-183, 186-191, 216-229, 237-251, 257-267, 272-282, 287-298 | H: 2 | 220-243 | 67, 211 |
| SP1687 | neuraminidase B (nanB) | 6-29, 34-47, 56-65, 69-76, 83-90, 123-134, 143-151, 158-178, 197-203, 217-235, 243-263, 303-309, 320-333, 338-348, 367-373, 387-393, 407-414, 416-427, 441-457, 473-482, 487-499, 501-509, 514-520, 530-535, 577-583, 590-602, 605-612, 622-629, 641-670, 678-690 | B: 3, E: 2, L: 1, M: 2 | 37-71 238-307 | 68, 212 |
| SP1693 | neuraminidase A (nanA) | 7-40, 121-132, 148-161, 196-202, 209-215, 221-235, 248-255, 271-280, 288-295, 330-339, 395-409, 414-420, 446-451, 475-487, 556-563, 568-575, 580-586, 588-595, 633-638, 643-648, 652-659, 672-685, 695-700, 710-716, 737-742, 749-754, 761-767, 775-781, 796-806, 823-835, 850-863, 884-890, 892-900, 902-915, 934-941 | C: 3, D: 5, E: 3, F: 1, G: 7, H: 1, I: 3, K: 20, L: 4 | 406-521 | 69, 213 |
| SP1732 | serine/threonine protein kinase | 9-18, 24-46, 51-58, 67-77, 85-108, 114-126, 129-137, 139-146, 152-165, 173-182, 188-195, 197-204, 217-250, 260-274, 296-313, 343-366, 368-384, 427-434, 437-446, 449-455, 478-484, 492-506, 522-527, 562-591, 599-606, 609-618, 625-631, 645-652 | E: 2, H: 1 | 577-654 | 70, 214 |
| SP1735 | methionyl-tRNA formyltransferase (fmt) | 13-20, 26-37, 41-53, 56-65, 81-100, 102-114, 118-127, 163-188, 196-202, 231-238, 245-252, 266-285, 293-298, 301-306 | K: 13, M: 13 | 19-78 | 71, 215 |
| SP1759 | preprotein translocase, SecA subunit (secA-2) | 10-23, 32-42, 54-66, 73-91, 106-113, 118-127, 139-152, 164-173, 198-207, 210-245, 284-300, 313-318, 330-337, 339-346, 354-361, 387-393, 404-426, 429-439, 441-453, 467-473, 479-485, 496-509, 536-544, 551-558, 560-566, 569-574, 578-588, 610-615, 627-635, 649-675, 679-690, 698-716, 722-734, 743-754, 769-780, 782-787 | I: 6, L: 2, M: 2 | 480-550 | 72, 216 |
| SP1772 | cell wall surface anchor family protein | 6-39, 42-50, 60-68, 76-83, 114-129, 147-162, 170-189, 197-205, 217-231, 239-248, 299-305, 338-344, 352-357, 371-377, 380-451, 459-483, 491-499, 507-523, 537-559, 587-613, 625-681, 689-729, 737-781, 785-809, 817-865, 873-881, 889-939, 951-975, 983-1027, 1031-1055, 1063-1071, 1079-1099, 1103-1127, 1151-1185, 1197-1261, 1269-1309, 1317-1333, 1341-1349, 1357-1465, 1469-1513, 1517-1553, 1557-1629, 1637-1669, 1677-1701, 1709-1725, 1733-1795, 1823-1849, 1861-1925, 1933-1973, 1981-2025, 2029-2053, 2061-2109, 2117-2125, 2133-2183, 2195-2219, 2227-2271, 2275-2299, 2307-2315, 2323-2343, 2347-2371, 2395-2429, 2441-2529, 2537-2569, 2577-2601, 2609-2625, 2633-2695, 2699-2737, 2765-2791, 2803-2867, 2889-2913, 2921-2937, 2945-2969, 2977-2985, 2993-3009, 3023-3045, 3073-3099, 3111-3167, 3175-3215, 3223-3267, 3271-3295, 3303-3351, 3359-3367, 3375-3425, 3437-3461, 3469-3513, 3517-3541, 3549-3557, 3565-3585, 3589-3613, 3637-3671, 3683-3747, 3755-3795, 3803-3819, 3827-3835, 3843-3951, 3955-3999, | B: 9, C: 1, D: 1, F: 13, G: 1, H: 3, I: 1, L: 1, M: 2 | 74-171 452-559 2951-3061 | 73, 217 |

TABLE 1-continued

Immunogenic proteins identified by bacterial surface display.

| S. pneumoniae antigenic protein | Putative function (by homology) | predicted immunogenic aa** | No. of selected clones per ORF and screen | Location of identified immunogenic region (aa) | Seq. ID (DNA, Prot.) |
|---|---|---|---|---|---|
| | | 4003-4039, 4043-4115, 4123-4143, 4147-4171, 4195-4229, 4241-4305, 4313-4353, 4361-4377, 4385-4393, 4401-4509, 4513-4557, 4561-4597, 4601-4718, 4749-4768 | | | |
| SP1804 | general stress protein 24, putative | 16-22, 30-51, 70-111, 117-130, 137-150, 171-178, 180-188, 191-196 | I: 4 | 148-181 | 74, 218 |
| SP1888 | oligopeptide ABC transporter, ATP-binding protein AmiE | 6-19, 21-46, 50-56, 80-86, 118-126, 167-186, 189-205, 211-242, 244-267, 273-286, 290-297, 307-316, 320-341 | H: 1 | 34-60 | 75, 219 |
| SP1891 | oligopeptide ABC transporter, | 5-26, 33-43, 48-54, 58-63, 78-83, 113-120, 122-128, 143-152, 157-175, 185-192, 211-225, 227-234, 244-256, 270-281, 284-290, 304-310, 330-337, 348-355, 362-379, 384-394, 429-445, 450-474, 483-490, 511-520, 537-546, 548-554, 561-586, 590-604, 613-629 | A: 2, B: 3, E: 1, F: 1, G: 13, H: 8 | 149-186 285-431 573-659 | 76, 220 |
| SP1937 | Autolysin (lytA) | 5-26, 49-59, 61-67, 83-91, 102-111, 145-157, 185-192, 267-272, 279-286, 292-298, 306-312 | D: 3, F: 1, G: 1, H: 2, K: 11, M: 1 | 134-220 235-251 254-280 | 77, 221 |
| SP1954 | serine protease, subtilase family, authentic frame | 5-19, 72-79, 83-92, 119-124, 140-145, 160-165, 167-182, 224-232, 240-252, 259-270, 301-310, 313-322, 332-343, 347-367, 384-398, 416-429, 431-446, 454-461 | C: 43, E: 6, I: 4, K: 21, L: 50 | 1-169 | 78, 222 |
| SP1980 | cmp-binding-factor 1 (cbf1) | 8-17, 26-31, 56-62, 75-83, 93-103, 125-131, 135-141, 150-194, 205-217, 233-258, 262-268, 281-286 | H: 9 | 127-168 | 79, 223 |
| SP1992 | cell wall surface anchor family protein | 6-12, 69-75, 108-115, 139-159, 176-182, 194-214 | B: 5, C: 1, F: 4, I: 1 | 46-161 | 80, 224 |
| SP1999 | catabolite control protein A (ccpA) | 6-13, 18-27, 39-48, 51-59, 66-73, 79-85, 95-101, 109-116, 118-124, 144-164, 166-177, 183-193, 197-204, 215-223, 227-236, 242-249, 252-259, 261-270, 289-301, 318-325 | I: 2 | 12-58 | 81, 225 |
| SP2021 | glycosyl hydrolase | 4-10, 26-32, 48-60, 97-105, 117-132, 138-163, 169-185, 192-214, 219-231, 249-261, 264-270, 292-308, 343-356, 385-392, 398-404, 408-417, 435-441 | L: 3 | 24-50 | 82, 226 |
| SP2027 | Conserved hypothetical protein | 10-40, 42-48, 51-61, 119-126 | A: 1, E: 1, G: 19, H: 12, I: 16, L: 5 | 1-118 | 83, 227 |
| SP2039 | conserved hypothetical protein | 5-17, 40-58, 71-83, 103-111, 123-140, 167-177, 188-204 | G: 1, L: 3 | 116-128 | 84, 228 |
| SP2048 | Conserved hypothetical protein | 4-9, 11-50, 57-70, 112-123, 127-138 | I: 1, L: 4 | 64-107 | 85, 229 |
| SP2051 | Conpetence protein CglC | 9-39, 51-67 | D: 1, G: 3, I: 8, L: 26 | 1-101 | 86, 230 |
| SP2092 | UTP-glucose-1-phosphate uridylyltransferase (galU) | 5-14, 17-25, 28-46, 52-59, 85-93, 99-104, 111-120, 122-131, 140-148, 158-179, 187-197, 204-225, 271-283, 285-293 | H: 2 | 139-155 | 87, 231 |
| SP2099 | Penicillin binding protein 1B | 42-70, 73-90, 92-108, 112-127, 152-164, 166-172, 181-199, 201-210, 219-228, 247-274, 295-302, 322-334, 336-346, 353-358, 396-414, 419-425, 432-438, 462-471, 518-523, 531-536, 561-567, 576-589, 594-612, 620-631, 665-671, 697-710, 718-731, 736-756, 765-771, 784-801 | A: 1, B: 9, C: 11, D: 1, E: 6, F: 1, H: 4, K: 1 | 626-653 | 88, 232 |
| SP2108 | Maltose ABC transporter | 8-28, 41-51, 53-62, 68-74, 79-85, 94-100, 102-108, 114-120, 130-154, 156-162, 175-180, 198-204, 206-213, 281-294, 308-318, 321-339, 362-368, 381-386, 393-399, 407-415 | G: 10, H: 1, L: 10, M: 1 | 2-13 | 89, 233 |
| SP2120 | hypothetical protein | 4-39, 48-65, 93-98, 106-112, 116-129 | I: 2 | 10-36 | 90, 234 |
| SP2128 | transketolase, N-terminal subunit | 25-32, 35-50, 66-71, 75-86, 90-96, 123-136, 141-151, 160-179, 190-196, 209-215, 222-228, 235-242, 257-263, 270-280 | H: 2 | 209-247 | 91, 235 |

TABLE 1-continued

Immunogenic proteins identified by bacterial surface display.

| S. pneumoniae antigenic protein | Putative function (by homology) | predicted immunogenic aa** | No. of selected clones per ORF and screen | Location of identified immunogenic region (aa) | Seq. ID (DNA, Prot.) |
|---|---|---|---|---|---|
| SP2136 | choline binding protein PcpA | 5-29, 31-38, 50-57, 62-75, 83-110, 115-132, 168-195, 197-206, 216-242, 249-258, 262-269, 333-340, 342-350, 363-368, 376-392, 400-406, 410-421, 423-430, 436-442, 448-454, 460-466, 471-476, 491-496, 511-516, 531-536, 551-556, 571-576, 585-591, 599-605 | C: 3, F: 1, G: 24, H: 32, I: 13, K: 177, L: 34, M: 18 | 27-70 219-293 441-504 512-584 | 92, 236 |
| SP2141 | glycosyl hydrolase-related protein | 4-12, 14-34, 47-75, 83-104, 107-115, 133-140, 148-185, 187-196, 207-212, 224-256, 258-265, 281-287, 289-296, 298-308, 325-333, 345-355, 365-371, 382-395, 424-435, 441-457, 465-472, 483-491, 493-505, 528-534, 536-546, 552-558, 575-584, 589-600, 616-623 | L: 3 | 576-591 | 93, 237 |
| SP2180 | conserved hypothetical protein | 4-76, 78-89, 91-126, 142-148, 151-191, 195-208, 211-223, 226-240, 256-277, 279-285, 290-314, 317-323, 358-377, 381-387, 391-396, 398-411, 415-434, 436-446, 454-484, 494-512, 516-523, 538-552, 559-566, 571-577, 579-596, 599-615, 620-627, 635-644, 694-707, 720-734, 737-759, 761-771 | I: 3 | 313-329 | 94, 238 |
| SP2190 | choline binding protein A (cbpA) | 7-38, 44-49, 79-89, 99-108, 117-123, 125-132, 137-146, 178-187, 207-237, 245-255, 322-337, 365-387, 398-408, 445-462, 603-608, 623-628, 644-650, 657-671, 673-679 | A: 6, B: 12, C: 9, D: 6, E: 30, F: 8, G: 65, H: 72, I: 76, K: 222, L: 99, M: 37 | 111-566 | 95, 239 |
| SP2194 | ATP-dependent Clp protease, ATP-binding subunit | 6-20, 22-35, 39-45, 58-64, 77-117, 137-144, 158-163, 205-210, 218-224, 229-236, 239-251, 263-277, 299-307, 323-334, 353-384, 388-396, 399-438, 443-448, 458-463, 467-478, 481-495, 503-509, 511-526, 559-576, 595-600, 612-645, 711-721, 723-738, 744-758, 778-807 | H: 1 | 686-720 | 96, 240 |
| SP2201 | choline binding protein D (cbpD) | 10-33, 35-41, 72-84, 129-138, 158-163, 203-226, 243-252, 258-264, 279-302, 322-329, 381-386, 401-406, 414-435 | B: 4, C: 3, D: 1, E: 7, F: 1, G: 1, H: 2, K: 26, M: 1 | 184-385 | 97, 241 |
| SP2204 | ribosomal protein L9 | 4-9, 19-24, 41-47, 75-85, 105-110, 113-146 | H: 3, L: 4 | 45-62 | 98, 242 |
| SP2216 | secreted 45 kd protein - homology to glucan binding protein (GbpB) S. mutant | 4-25, 52-67, 117-124, 131-146, 173-180, 182-191, 195-206, 215-221, 229-236, 245-252, 258-279, 286-291, 293-302, 314-320, 327-336, 341-353, 355-361, 383-389 | A: 130, B: 414, C: 450, D: 162, E: 166, F: 284, G: 90, H: 16, I: 4, K: 10, L: 29, M: 11 | 1-285 | 99, 243 |
| SP-NRF1 | Choline binding protein | 14-32, 38-50, 73-84, 93-105, 109-114 | H: 1 | 40-70 | 100, 244 |
| ARF0408 | Hypothetical protein | 5-26 | L: 3 | 22-34 | 101, 245 |
| ARF0441 | Hypothetical protein | 23-28 | H: 3 | 13-39 | 102, 246 |
| ARF0690 | Hypothetical protein | 8-14 | L: 2 | 21-34 | 103, 247 |
| ARF0878 | Hypothetical protein | 4-13, 20-29, 44-50, 59-74 | H: 3 | 41-69 | 104, 248 |
| ARF0921 | Hypothetical protein | 4-9, 19-42, 48-59, 71-83 | M: 4 | 57-91 | 105, 249 |
| ARF1153 | Hypothetical protein | 4-14 | M: 7 | 10-28 | 106, 250 |
| ARF1515 | Hypothetical protein | 22-28, 32-42, 63-71, 81-111, 149-156, 158-167, 172-180, 182-203, 219-229 | G: 4, H: 5 | 27-49 | 107, 251 |
| ARF1519 | Hypothetical protein | 17-27 | H: 3 | 23-32 | 108, 252 |
| ARF1905 | Hypothetical protein | 18-24 | H: 2 | 28-38 | 109, 253 |
| ARF2044 | Hypothetical protein | 9-15 | G: 2, H: 5 | 13-27 | 110, 254 |
| ARF2155 | Hypothetical protein | 13-22 | H: 3 | 18-29 | 111, 255 |
| ARF2199 | Hypothetical protein | 17-26 | M: 3 | 2-11 | 112, 256 |
| CRF0129 | Hypothetical protein | 4-33 | L: 4 | 16-32 | 113, 257 |

TABLE 1-continued

Immunogenic proteins identified by bacterial surface display.

| S. pneumoniae antigenic protein | Putative function (by homology) | predicted immunogenic aa** | No. of selected clones per ORF and screen | Location of identified immunogenic region (aa) | Seq. ID (DNA, Prot.) |
|---|---|---|---|---|---|
| CRF0200 | Hypothetical protein | 4-10, 37-43, 54-84, 92-127 | H: 5, L: 1 | 15-62 | 114, 258 |
| CRF0236 | Hypothetical protein | 4-14, 20-32, 35-60, 69-75, 79-99, 101-109, 116-140 | L: 3 | 124-136 | 115, 259 |
| CRF0394 | Hypothetical protein | none | H: 7 | 2-13 | 116, 260 |
| CRF0408 | Hypothetical protein | 4-13, 28-42 | L: 11 | 42-57 | 117, 261 |
| CRF0430 | Hypothetical protein | 4-14, 27-44 | G: 4, H: 8 | 14-35 | 118, 262 |
| CRF0498 | Hypothetical protein | 4-12 | H: 4 | 1-27 | 119, 263 |
| CRF0519 | Hypothetical protein | 4-18, 39-45, 47-74 | G: 5, H: 3 | 35-66 | 120, 264 |
| CRF0573 | Hypothetical protein | 8-20, 43-77 | I: 3, L: 9 | 17-36 | 121, 265 |
| CRF0713 | Hypothetical protein | 4-30, 35-45, 51-57 | L: 3 | 35-49 | 122, 266 |
| CRF0722 | Hypothetical protein | 4-24, 49-57 | G: 18 | 15-34 | 123, 267 |
| CRF0764 | Hypothetical protein | 4-22 | L: 4 | 8-27 | 124, 268 |
| CRF1079 | Hypothetical protein | 13-25, 32-59, 66-80 | H: 5 | 21-55 | 125, 269 |
| CRF1248 | Hypothetical protein | 4-10, 24-33, 35-42, 54-65, 72-82, 98-108 | H: 1 | 15-30 | 126, 270 |
| CRF1398 | Hypothetical protein | 8-19 | H: 1, L: 3 | 17-47 | 127, 271 |
| CRF1412 | Hypothetical protein | 12-18, 40-46 | L: 8 | 31-52 | 128, 272 |
| CRF1467 | Hypothetical protein | 4-20, 35-78, 83-102, 109-122 | I: 4 | 74-86 | 129, 273 |
| CRF1484 | Hypothetical protein | 7-17, 21-41, 46-63 | I: 5 | 2-20 | 130, 274 |
| CRF1587 | Hypothetical protein | 30-37 | G: 3, H: 3, L: 4 | 2-33 | 131, 275 |
| CRF1606 | Hypothetical protein | 4-13, 17-25 | L: 3 | 1-15 | 132, 276 |
| CRF1623 | Hypothetical protein | 17-31, 44-51 | M: 6 | 20-51 | 133, 277 |
| CRF1625 | Hypothetical protein | 20-30 | L: 10 | 5-23 | 134, 278 |
| CRF1640 | Hypothetical protein | 13-33, 48-71 | I: 5 | 92-110 | 135, 279 |
| CRF1702 | Hypothetical protein | 4-9, 50-69, 76-88, 96-106, 113-118 | L: 6 | 12-34 | 136, 280 |
| CRF1825 | Hypothetical protein | 4-24 | L: 11 | 6-26 | 137, 281 |
| CRF1883 | Hypothetical protein | 7-26 | H: 61, L: 77 | 14-30 | 138, 282 |
| CRF1991 | Hypothetical protein | 9-39, 46-68, 75-82, 84-103 | H: 6, L: 2 | 26-44 | 139, 283 |
| CRF1992 | Hypothetical protein | 4-30, 33-107 | M: 7 | 58-84 | 140, 284 |
| CRF2004 | Hypothetical protein | 4-12 | L: 3 | 9-51 | 141, 285 |
| CRF2030 | Hypothetical protein | 12-18, 29-37 | H: 5, L: 1, M: 1 | 6-37 | 142, 286 |
| CRF2065 | Hypothetical protein | 4-21, 33-52, 64-71 | I: 1, M: 6 | 16-37 | 143, 287 |
| CRF2232 | Hypothetical protein | 9-19 | L: 3 | 2-30 | 144, 288 |

TABLE 2

Immunogenicity of epitopes in peptide ELISA

| Peptides | P1 | P2 | P3 | P4 | P5 | P6 | P7 | P8 | P9 | P10 | P11 | P12 | P13 | N1 |
|---|---|---|---|---|---|---|---|---|---|---|---|---|---|---|
| ARF040 | n | | | ▨ | ▨ | nd | | nd | ▨ | ▨ | ▨ | | | |
| ARF044 | n | | ▨ | ▨ | | nd | ▨ | nd | ▨ | ▨ | ▨ | ▨ | | |
| ARF069 | n | | ▨ | ▣ | ▨ | nd | ▨ | nd | ▨ | ▨ | ▨ | | | |
| ARF087 | ▨ | ▨ | ▨ | ▨ | ▨ | nd | ▨ | ▨ | ▨ | | nd | nd | | ▨ |
| ARF087 | ▨ | | | | ▨ | nd | ▨ | ▨ | | | nd | nd | | ▨ |
| ARF092 | ▨ | ▨ | | | | nd | ▨ | | | | nd | nd | | ▨ |
| ARF092 | ▨ | | ▨ | | | nd | | ▨ | | | nd | nd | | ▨ |
| ARF115 | n | | | ▨ | ▨ | nd | ▨ | nd | ▨ | ▣ | ▨ | | | |
| ARF151 | n | ▨ | | ▨ | ▨ | nd | | nd | ▨ | ▨ | ▨ | | | |
| ARF151 | n | | | ▨ | ▨ | nd | ▨ | nd | | ▨ | | | | |
| ARF190 | n | ▨ | ▨ | ▨ | | nd | ▨ | nd | ▨ | ▨ | ▨ | | | |
| ARF204 | n | | | ▨ | ▨ | nd | ▨ | nd | | | | ▨ | | |
| ARF215 | n | | | ▨ | ▨ | nd | ▨ | nd | | ▨ | | | | |
| ARF219 | n | | ▨ | ▨ | ▨ | nd | ▨ | nd | ▨ | ▨ | | | | |

TABLE 2-continued

Immunogenicity of epitopes in peptide ELISA

| | | | | | | | | | | | | | | |
|---|---|---|---|---|---|---|---|---|---|---|---|---|---|---|
| CRF012 | n | | | | | nd | | nd | | | | | | |
| CRF020 | n | | | | | nd | | nd | | | | | | |
| CRF020 | n | | | | | nd | | nd | | | | | | |
| CRF020 | n | | | | | nd | | nd | | | | | | |
| CRF023 | | | | | | nd | | | | | | nd | nd | |
| CRF039 | n | | | | | nd | | nd | | | | | | |
| CRF040 | n | | | | | nd | | nd | | | | | | |
| CRF043 | n | | | | | nd | | nd | | | | | | |
| CRF049 | n | | | | | nd | | nd | | | | | | |
| CRF057 | | | | | | nd | | | | | | nd | nd | |
| CRF071 | n | | | | | nd | | nd | | | | | | |
| CRF076 | n | | | | | nd | | nd | | | | | | |
| CRF107 | n | | | | | nd | | nd | | | | | | |
| CRF139 | n | | | | | nd | | nd | | | | | | |
| CRF139 | n | | | | | nd | | nd | | | | | | |
| CRF141 | | | | | | nd | | | | | | nd | nd | |
| CRF146 | n | | | | | nd | | nd | | | | | | |
| CRF148 | n | | | | | nd | | nd | | | | | | |
| CRF158 | n | | | | | nd | | nd | | | | | | |
| CRF158 | n | | | | | nd | | nd | | | | | | |
| CRF160 | n | | | | | nd | | nd | | | | | | |
| CRF162 | n | | | | | nd | | nd | | | | | | |
| CRF164 | n | | | | | nd | | nd | | | | | | |
| CRF170 | | | | | | nd | | | | | | nd | nd | |
| CRF182 | n | | | | | nd | | nd | | | | | | |
| CRF182 | n | | | | | nd | | nd | | | | | | |
| CRF188 | n | | | | | nd | | nd | | | | | | |
| CRF199 | n | | | | | nd | | nd | | | | | | |
| CRF199 | n | | | | | | | nd | | | nd | | | |
| CRF200 | n | | | | | nd | | nd | | | | | | |
| CRF200 | n | | | | | nd | | nd | | | | | | |
| CRF203 | n | | | | | nd | | nd | | | | | | |
| CRF203 | n | | | | | nd | | nd | | | | | | |
| CRF206 | n | | | | | nd | | nd | | | | | | |
| CRF223 | n | | | | | nd | | nd | | | | | | |
| CRF223 | n | | | | | nd | | nd | | | | | | |
| SP0008. | | | | | | | | | | | nd | nd | nd | |
| SP0008. | | | | | | | | | | | nd | nd | nd | |
| SP0069. | | | | | | nd | | | | | | nd | nd | |
| SP0071. | n | | | | | nd | | nd | | | | | | |
| SP0071. | | | | | | nd | | | | | | nd | nd | |

TABLE 2-continued

Immunogenicity of epitopes in peptide ELISA

TABLE 2-continued

Immunogenicity of epitopes in peptide ELISA (table of immunogenicity data with shaded/filled squares and "nd" entries for rows SP0498, SP0519, SP0529, SP0564, SP0609, SP0641, SP0648, SP0664, SP0667, SP0749, SP0770, SP0785, SP0930, SP0943)

TABLE 2-continued

Immunogenicity of epitopes in peptide ELISA (table content not transcribable - consists of row labels SP1004, SP1154, SP1175, SP1241, SP1287, SP1330, SP1374, SP1429, SP1518, SP1522, SP1527, SP1604, SP1661, SP1664, SP1693 with graphical cell markers and "nd" notations)

TABLE 2-continued

Immunogenicity of epitopes in peptide ELISA (table data not transcribable - consists of SP identifiers SP1732 through SP2216 with graphical cell patterns indicating immunogenicity results, with "nd" markers for not determined values)

TABLE 2-continued

Immunogenicity of epitopes in peptide ELISA

| Peptides | N2 | N3 | N4 | N5 | N6 | N7 | N8 | N9 | N10 | S | from | to | Seq ID |
|---|---|---|---|---|---|---|---|---|---|---|---|---|---|
| ARF040 | | | | | | | | | | 15 | 20 | 37 | 24 |
| ARF044 | | ■ | | | | | | | | 26 | 8 | 27 | 24 |
| ARF069 | | | | | | | | | | 20 | 10 | 27 | 24 |
| ARF087 | ■ | | | | | | | | | 22 | 42 | 59 | 24 |
| ARF087 | | | | | | | | | | 11 | 52 | 69 | 24 |
| ARF092 | | | | | | | | | | 15 | 63 | 80 | 24 |
| ARF092 | | | | | | | | | | 14 | 74 | 91 | 24 |
| ARF115 | | | | | | | | | | 19 | 11 | 28 | 25 |
| ARF151 | | | | | | | | | | 18 | 28 | 49 | 25 |
| ARF151 | | | | | | | | | | 15 | 15 | 32 | 25 |
| ARF190 | | | | | | | | | | 21 | 4 | 20 | 25 |
| ARF204 | | | | | | | | | | 18 | 10 | 27 | 25 |
| ARF215 | | | | | | | | | | 15 | 17 | 34 | 25 |
| ARF219 | | | | | | | | | | 19 | 1 | 18 | 25 |
| CRF012 | | | | | | | | | | 15 | 16 | 33 | 25 |
| CRF020 | | | | | | | | | | 12 | 16 | 36 | 25 |
| CRF020 | | | | | | | | | | 9 | 30 | 49 | 25 |
| CRF020 | | | | | | | | | | 10 | 43 | 62 | 25 |
| CRF023 | | | | | | | | | | 19 | 122 | 139 | 25 |
| CRF039 | | | | | | | | | | 20 | 1 | 18 | 26 |
| CRF040 | | | | | | | | | | 19 | 41 | 58 | 26 |
| CRF043 | | | | | | | | | | 15 | 15 | 35 | 26 |
| CRF049 | | | | | | | | | | 21 | 2 | 27 | 26 |
| CRF057 | ■ | | | | | | | | | 22 | 18 | 36 | 26 |
| CRF071 | | | | | ■ | | | | | 20 | 34 | 51 | 26 |
| CRF076 | | | | | | | | | | 16 | 9 | 27 | 26 |
| CRF107 | | ■ | ■ | | | | | | | 27 | 22 | 47 | 26 |
| CRF139 | | | | | | | | | | 24 | 18 | 36 | 27 |
| CRF139 | | | | | | | | | | 21 | 29 | 47 | 27 |
| CRF141 | | | | | | | | | | 9 | 32 | 52 | 27 |
| CRF146 | | | | | | | | | | | 72 | 89 | 27 |
| CRF148 | | | | | | ■ | | | | | 3 | 20 | 27 |
| CRF158 | | | | | | | | | | 23 | 3 | 21 | 27 |
| CRF158 | | | | | | | | | | 21 | 15 | 33 | 27 |
| CRF160 | | | | | | | | | | 22 | 1 | 18 | 27 |

TABLE 2-continued

Immunogenicity of epitopes in peptide ELISA

| | | | | | | | | | | | | | | |
|---|---|---|---|---|---|---|---|---|---|---|---|---|---|---|
| CRF162 | | | | | | | | | | 23 | 6 | 23 | 27 |
| CRF164 | | | | | | | | | | 18 | 93 | 110 | 27 |
| CRF170 | | | | | | | | | | 18 | 13 | 34 | 28 |
| CRF182 | | | | | | | | | | 24 | 7 | 26 | 28 |
| CRF182 | | | | | | | | | | 24 | 9 | 26 | 28 |
| CRF188 | | | | | | | | | | 20 | 16 | 33 | 28 |
| CRF199 | | | | | | | | | | 24 | 27 | 44 | 28 |
| CRF199 | | | | | | | | | | 19 | 67 | 84 | 28 |
| CRF200 | | | | | | | | | | 20 | 10 | 33 | 28 |
| CRF200 | | | | | | | | | | 22 | 26 | 50 | 28 |
| CRF203 | | | | | | | | | | 21 | 7 | 25 | 28 |
| CRF203 | | | | | | | | | | 20 | 19 | 37 | 28 |
| CRF206 | | | | | | | | | | 21 | 17 | 37 | 28 |
| CRF223 | | | | | | | | | | 23 | 3 | 20 | 28 |
| CRF223 | | | | | | | | | | 19 | 13 | 30 | 28 |
| SP0008. | | | | | | | | | | 28 | 62 | 80 | 14 |
| SP0008. | | | | | | | | | | 21 | 75 | 93 | 14 |
| SP0069. | | | | | | | | | | 17 | 92 | 108 | 14 |
| SP0071. | | | | | | | | | | 15 | 332 | 349 | 14 |
| SP0071. | | | | | | | | | | 13 | 177 | 200 | 14 |
| SP0071. | | | | | | | | | | 4 | 175 | 177 | 14 |
| SP0082. | | | | | | | | | | 4 | 109 | 133 | 14 |
| SP0082. | | | | | | | | | | 24 | 149 | 174 | 14 |
| SP0082. | | | | | | | | | | 26 | 260 | 285 | 14 |
| SP0082. | | | | | | | | | | 20 | 460 | 485 | 14 |
| SP0107. | | | | | | | | | | 10 | 26 | 47 | 15 |
| SP0107. | | | | | | | | | | 11 | 42 | 64 | 15 |
| SP0117. | | | | | | | | | | 18 | 22 | 41 | 15 |
| SP0117. | | | | | | | | | | 57 | 35 | 54 | 15 |
| SP0117. | | | | | | | | | | 64 | 115 | 130 | 15 |
| SP0117. | | | | | | | | | | 17 | 306 | 325 | 15 |
| SP0117. | | | | | | | | | | 15 | 401 | 420 | 15 |
| SP0117. | | | | | | | | | | 68 | 454 | 478 | 15 |
| SP0222. | | | | | | | | | | 15 | 22 | 45 | 15 |
| SP0368. | | | | | | | | | | 22 | 156 | 174 | 16 |
| SP0368. | | | | | | | | | | 32 | 924 | 940 | 16 |
| SP0368. | | | | | | | | | | 12 | 148 | 149 | 16 |
| SP0368. | | | | | | | | | | 14 | 144 | 146 | 16 |
| SP0368. | | | | | | | | | | 11 | 148 | 149 | 16 |
| SP0369. | | | | | | | | | | 16 | 457 | 475 | 16 |

TABLE 2-continued

Immunogenicity of epitopes in peptide ELISA

| Name | | | | | | | | | A | B | C | D |
|---|---|---|---|---|---|---|---|---|---|---|---|---|
| SP0377. | | ▨ | ▨ | | ▨ | | ▨ | ▨ | 11 | 302 | 325 | 16 |
| SP0378. | | | ▨ | | ▨ | | ▨ | ▨ | 17 | 288 | 305 | 16 |
| SP0390. | | | | ▨ | | ▨ | ▨ | | 11 | 244 | 266 | 16 |
| SP0390. | ▨ | ▨ | ▨ | ▨ | ▨ | ▨ | | ▨ | 24 | 260 | 282 | 16 |
| SP0454. | ■ | ■ | ■ | ▨ | ■ | ▨ | ▨ | ▨ | 64 | 204 | 225 | 16 |
| SP0454. | ▨ | ▨ | ■ | | ■ | | ▨ | ▨ | 38 | 220 | 241 | 16 |
| SP0463. | ▨ | ▨ | ▨ | ▨ | | ▨ | | ▨ | 20 | 324 | 345 | 16 |
| SP0463. | ▨ | ■ | ■ | | ▨ | ▨ | ▨ | ▨ | 26 | 340 | 361 | 16 |
| SP0463. | ▨ | ▨ | ▨ | ▨ | | | | ▨ | 19 | 356 | 377 | 16 |
| SP0463. | ▨ | ▨ | | ▨ | | | | ▨ | 9 | 372 | 393 | 16 |
| SP0463. | ▨ | ▨ | ▨ | ▨ | | | | ▨ | 13 | 388 | 408 | 16 |
| SP0466. | | ▨ | | ▨ | ▨ | ▨ | ▨ | ▨ | 22 | 39 | 64 | 16 |
| SP0468. | ▨ | ▨ | | ▨ | ▨ | ▨ | ▨ | ▨ | 21 | 54 | 76 | 16 |
| SP0468. | ▨ | ▨ | ▨ | ▨ | ▨ | ▨ | | ▨ | 24 | 70 | 92 | 16 |
| SP0498. | ▨ | ▨ | | ▨ | | | ▨ | ▨ | 13 | 122 | 124 | 17 |
| SP0498. | ▨ | ▨ | | | | | | | 8 | 153 | 155 | 17 |
| SP0498. | | ▨ | | ▨ | ▨ | | ▨ | ▨ | 16 | 155 | 157 | 17 |
| SP0498. | | ▨ | ▨ | | | ▨ | | | 13 | 156 | 158 | 17 |
| SP0498. | ▨ | ▨ | | | ▨ | ▨ | ▨ | ▨ | 15 | 158 | 160 | 17 |
| SP0498. | ▨ | ▨ | | | | ▨ | ▨ | ▨ | 11 | 124 | 126 | 17 |
| SP0498. | ▨ | ▨ | ▨ | ▨ | ▨ | ▨ | ■ | ▨ | 24 | 127 | 129 | 17 |
| SP0498. | ▨ | ▨ | | ▨ | | | | | 9 | 128 | 130 | 17 |
| SP0498. | ■ | ▤ | ■ | ■ | ■ | ▨ | ▨ | ■ | 63 | 145 | 147 | 17 |
| SP0498. | ■ | ■ | ■ | ■ | ■ | ▨ | ▨ | ■ | 59 | 147 | 149 | 17 |
| SP0498. | ▨ | ▨ | ▨ | ▨ | ▨ | ▨ | | ▨ | 20 | 148 | 151 | 17 |
| SP0498. | ▨ | ▨ | | ▨ | ▨ | | | | 10 | 150 | 152 | 17 |
| SP0519. | ▨ | ▨ | ■ | ▨ | | ▨ | ▨ | ▨ | 25 | 351 | 368 | 17 |
| SP0529. | ▨ | ▨ | | | | | | | 6 | 179 | 200 | 17 |
| SP0529. | ▨ | ▨ | ▨ | ▨ | ▨ | | | ▨ | 23 | 195 | 216 | 17 |
| SP0529. | ▨ | ▨ | | | ▨ | | | | 7 | 211 | 232 | 17 |
| SP0529. | ▨ | ▨ | | ▨ | | ▨ | | | 8 | 227 | 248 | 17 |
| SP0529. | ▨ | ■ | ▨ | ▨ | | | | | 18 | 243 | 263 | 17 |
| SP0564. | ▤ | ■ | ■ | ▨ | ■ | ■ | ■ | ■ | 63 | 13 | 37 | 17 |
| SP0609. | ▨ | ▨ | ▨ | ▨ | ▨ | ▨ | ▨ | ▨ | 16 | 208 | 224 | 17 |
| SP0641. | ▨ | ▨ | ▨ | ▨ | ▨ | ■ | ■ | ▨ | 34 | 42 | 64 | 17 |
| SP0641. | ■ | ▤ | ■ | ■ | ■ | ■ | ■ | ▨ | 61 | 59 | 81 | 17 |
| SP0641. | | | | | | | | | 0 | 304 | 328 | 17 |
| SP0641. | ▨ | ▨ | ▨ | ▨ | ▨ | ▨ | ▨ | ■ | 36 | 323 | 348 | 17 |
| SP0641. | ■ | ▤ | ■ | ▤ | ■ | ▤ | ■ | ■ | 76 | 465 | 489 | 17 |
| SP0641. | ▨ | ■ | ■ | ▨ | ■ | ▨ | ▨ | ■ | 64 | 968 | 992 | 17 |
| SP0641. | ▨ | ■ | ■ | ▨ | ■ | ▨ | ■ | ▨ | 52 | 139 | 141 | 17 |

TABLE 2-continued

Immunogenicity of epitopes in peptide ELISA

| | | | | | |
|---|---|---|---|---|---|
| SP0641. | | 25 | 141 | 143 | 17 |
| SP0641. | | 18 | 209 | 211 | 17 |
| SP0648. | | 11 | 152 | 154 | 17 |
| SP0648. | | 24 | 154 | 156 | 17 |
| SP0664. | | 28 | 184 | 200 | 17 |
| SP0664. | | 18 | 367 | 388 | 17 |
| SP0664. | | 15 | 382 | 403 | 17 |
| SP0664. | | 14 | 409 | 429 | 17 |
| SP0664. | | 20 | 425 | 444 | 17 |
| SP0664. | | 17 | 438 | 457 | 17 |
| SP0667. | | 22 | 27 | 50 | 18 |
| SP0667. | | 16 | 45 | 67 | 18 |
| SP0749. | | 24 | 114 | 131 | 18 |
| SP0770. | | 17 | 405 | 419 | 18 |
| SP0785. | | 11 | 113 | 134 | 18 |
| SP0785. | | 10 | 129 | 150 | 18 |
| SP0785. | | 8 | 145 | 166 | 18 |
| SP0785. | | 11 | 161 | 182 | 18 |
| SP0785. | | 8 | 177 | 198 | 18 |
| SP0930. | | 30 | 495 | 515 | 18 |
| SP0943. | | 19 | 346 | 358 | 18 |
| SP1004. | | 21 | 208 | 224 | 19 |
| SP1154. | | 33 | 178 | 194 | 19 |
| SP1154. | | 24 | 154 | 156 | 17 |
| SP1154. | | 21 | 217 | 238 | 19 |
| SP1154. | | 19 | 288 | 308 | 19 |
| SP1154. | | 16 | 135 | 137 | 19 |
| SP1175. | | 56 | 57 | 78 | 19 |
| SP1241. | | 26 | 347 | 369 | 19 |
| SP1241. | | 18 | 364 | 386 | 19 |
| SP1241. | | 25 | 381 | 403 | 19 |
| SP1241. | | 21 | 398 | 420 | 19 |
| SP1241. | | 26 | 415 | 437 | 19 |
| SP1241. | | 16 | 432 | 452 | 19 |
| SP1287. | | 20 | 347 | 372 | 19 |
| SP1330. | | 18 | 147 | 163 | 19 |
| SP1374. | | 15 | 263 | 288 | 20 |
| SP1429. | | 20 | 361 | 377 | 20 |
| SP1518. | | 19 | 82 | 104 | 20 |
| SP1518. | | 28 | 99 | 121 | 20 |
| SP1518. | | 21 | 116 | 138 | 20 |

TABLE 2-continued

Immunogenicity of epitopes in peptide ELISA

| ID | | | | | | | | | | a | b | c | d |
|---|---|---|---|---|---|---|---|---|---|---|---|---|---|
| SP1518. | | | | | | | | | | 26 | 133 | 155 | 20 |
| SP1518. | | | | | | | | | | 19 | 150 | 171 | 20 |
| SP1522. | | | | | | | | | | 12 | 110 | 130 | 20 |
| SP1522. | | | | | | | | | | 13 | 125 | 145 | 20 |
| SP1527. | | | | | | | | | | 22 | 613 | 631 | 20 |
| SP1527. | | | | | | | | | | 20 | 626 | 644 | 20 |
| SP1527. | | | | | | | | | | 16 | 196 | 213 | 20 |
| SP1604. | | | | | | | | | | 13 | 78 | 100 | 20 |
| SP1604. | | | | | | | | | | 20 | 95 | 117 | 20 |
| SP1604. | | | | | | | | | | 15 | 112 | 134 | 20 |
| SP1604. | | | | | | | | | | 25 | 129 | 151 | 20 |
| SP1661. | | | | | | | | | | 18 | 158 | 180 | 20 |
| SP1661. | | | | | | | | | | 10 | 175 | 197 | 20 |
| SP1661. | | | | | | | | | | 13 | 192 | 214 | 20 |
| SP1661. | | | | | | | | | | 16 | 209 | 231 | 20 |
| SP1661. | | | | | | | | | | 12 | 226 | 248 | 20 |
| SP1664. | | | | | | | | | | 24 | 30 | 50 | 21 |
| SP1664. | | | | | | | | | | 26 | 45 | 65 | 21 |
| SP1664. | | | | | | | | | | 11 | 60 | 79 | 21 |
| SP1693. | | | | | | | | | | 20 | 431 | 455 | 21 |
| SP1693. | | | | | | | | | | 18 | 450 | 474 | 21 |
| SP1732. | | | | | | | | | | 25 | 579 | 601 | 21 |
| SP1732. | | | | | | | | | | 15 | 596 | 618 | 21 |
| SP1732. | | | | | | | | | | 19 | 613 | 635 | 21 |
| SP1732. | | | | | | | | | | 22 | 630 | 653 | 21 |
| SP1772. | | | | | | | | | | 27 | 920 | 927 | 21 |
| SP1772. | | | | | | | | | | 12 | 98 | 119 | 21 |
| SP1772. | | | | | | | | | | 20 | 114 | 135 | 21 |
| SP1772. | | | | | | | | | | 11 | 130 | 151 | 21 |
| SP1772. | | | | | | | | | | 30 | 146 | 167 | 21 |
| SP1772. | | | | | | | | | | 19 | 162 | 182 | 21 |
| SP1888. | | | | | | | | | | 16 | 36 | 59 | 21 |
| SP1891. | | | | | | | | | | 14 | 194 | 216 | 22 |
| SP1891. | | | | | | | | | | 12 | 381 | 404 | 22 |
| SP1937. | | | | | | | | | | 20 | 236 | 251 | 22 |
| SP1937. | | | | | | | | | | 26 | 255 | 279 | 22 |
| SP1954. | | | | | | | | | | 15 | 80 | 100 | 22 |
| SP1954. | | | | | | | | | | 14 | 141 | 164 | 22 |
| SP1980. | | | | | | | | | | 18 | 128 | 154 | 22 |
| SP1992. | | | | | | | | | | 20 | 82 | 100 | 22 |
| SP1992. | | | | | | | | | | 23 | 95 | 116 | 22 |

TABLE 2-continued

Immunogenicity of epitopes in peptide ELISA

| ORF | | | | |
|---|---|---|---|---|
| SP1992. | 20 | 111 | 134 | 22 |
| SP2027. | 12 | 55 | 76 | 22 |
| SP2027. | 16 | 71 | 92 | 22 |
| SP2027. | 21 | 87 | 110 | 22 |
| SP2048. | 21 | 91 | 106 | 22 |
| SP2051. | 25 | 74 | 96 | 23 |
| SP2092. | 22 | 140 | 157 | 23 |
| SP2108. | 13 | 4 | 13 | 23 |
| SP2136. | 5 | 41 | 65 | 23 |
| SP2136. | 32 | 499 | 523 | 23 |
| SP2190. | 13 | 122 | 146 | 23 |
| SP2190. | 29 | 191 | 215 | 23 |
| SP2190. | 26 | 288 | 313 | 23 |
| SP2190. | 36 | 445 | 469 | 23 |
| SP2190. | 24 | 511 | 535 | 23 |
| SP2201. | 34 | 347 | 368 | 24 |
| SP2204. | 16 | 46 | 61 | 24 |
| SP2216. | 16 | 15 | 37 | 24 |
| SP2216. | 28 | 32 | 57 | 24 |
| SP2216. | 14 | 101 | 121 | 24 |
| SP2216. | 31 | 115 | 135 | 24 |
| SP2216. | 22 | 138 | 158 | 24 |
| SP2216. | 12 | 152 | 172 | 24 |
| SP2216. | 46 | 220 | 242 | 24 |
| SP2216. | 12 | 236 | 258 | 24 |

TABLE 3

Gene distribution in *S. pneumoniae* strains.

| ORF | Common name | Gene distribution (present of 50) | Amino acid substitutions (in serotype 14 strain)* | Homology ( ) | Seq. ID (DNA, Prot.) |
|---|---|---|---|---|---|
| SP0008 | hypothetical protein | n.d. | n.d. | | 1, 145 |
| SP0032 | DNA polymerase I (polA) | n.d. | n.d. | | 2, 146 |
| SP0069 | Choline binding protein I | 7 | 0/166# | | 3, 147 |
| SP0071 | immunoglobulin A1 protease (iga-1) | 7 | 0/477# | | 4, 148 |
| SP0082 | Cell wall surface anchor | 50 | 5/385 | | 5, 149 |
| SP0107 | LysM domain protein | 50 | 1/173 | | 6, 150 |
| SP0117 | pneumococcal surface protein A (pspA) | n.d. | n.d. | | 7, 151 |
| SP0191 | hypothetical protein | n.d. | n.d. | | 8, 152 |
| SP0197 | dihydrofolate synthetase, putative | n.d. | n.d. | | 9, 153 |
| SP0212 | Ribosomal protein L2 | 50 | 0/232 | | 10, 154 |
| SP0222 | Ribosomal protein S14 | n.d. | n.d. | | 11, 155 |
| SP0239 | Conserved hypothetical protein | n.d. | n.d. | | 12, 156 |
| SP0251 | formate acetyltransferase, putative | n.d. | n.d. | | 13, 157 |
| SP0295 | ribosomal protein S9 (rpsI) | 50 | 1/121 | | 14, 158 |

TABLE 3-continued

Gene distribution in *S. pneumoniae* strains.

| ORF | Common name | Gene distribution (present of 50) | Amino acid substitutions (in serotype 14 strain)* | Homology ( ) | Seq. ID (DNA, Prot.) |
|---|---|---|---|---|---|
| SP0330 | sugar binding transcriptional regulator RegR | n.d. | n.d. | | 15, 159 |
| SP0368 | cell wall surface anchor family protein | 46 | 4/422# | | 16, 160 |
| SP0369 | Penicillin binding protein 1A | 50 | 1/346 | | 17, 161 |
| SP0374 | hypothetical protein | n.d. | n.d. | | 18, 162 |
| SP0377 | Choline binding protein C | 29 | 0/114 | | 19, 163 |
| SP0378 | choline binding protein J (cbpJ) | 50 | 2/104 | | 20, 164 |
| SP0390 | choline binding protein G (cbpG) | 50 | 3/171# | | 21, 165 |
| SP0454 | hypothetical protein | 48 | 1/303# | | 22, 166 |
| SP0463 | cell wall surface anchor family protein | 10 | 0/298# | | 23, 167 |
| SP0466 | sortase, putative | 44 | 4/243# | | 24, 168 |
| SP0468 | Sortase, putative | 18 | 0/254# | | 25, 169 |
| SP0498 | endo-beta-N-acetylglucosaminidase, putative | 50 | 4/334 | | 26, 170 |
| SP0509 | type I restriction-modification system, M subunit | n.d. | n.d. | | 27, 171 |
| SP0519 | dnaJ protein (dnaJ) | 50 | 2/312 | | 28, 172 |
| SP0529 | BlpC ABC transporter (blpB) | 50 | 6/306 | | 29, 173 |
| SP0564 | hypothetical protein | 50 | 1/127 | | 30, 174 |
| SP0609 | amino acid ABC transporter, amino acid-binding pro | 50 | 0/232 | | 31, 175 |
| SP0613 | metallo-beta-lactamase superfamily protein | n.d. | n.d. | | 32, 176 |
| SP0641 | Serine protease | n.d. | n.d. | | 33, 177 |
| SP0648 | beta-galactosidase (bgaA) | 50 | 0/304 | | 34, 178 |
| SP0664 | Zinc metalloprotease ZmpB, putative | n.d. | n.d. | | 35, 179 |
| SP0667 | pneumococcal surface protein, putative | 45 | 18/297 | | 36, 180 |
| SP0688 | UDP-N-acetylmuramoylalanine--D-glutamate ligase | n.d. | n.d. | | 37, 181 |
| SP0749 | branched-chain amino acid ABC transporter | 50 | 4/303 | | 38, 182 |
| SP0770 | ABC transporter, ATP-binding protein | 50 | 0/307 | | 39, 183 |
| SP0785 | conserved hypothetical protein | 50 | 0/304 | | 40, 184 |
| SP0914 | nodulin-related protein, truncation | n.d. | n.d. | | 41, 185 |
| SP0930 | choline binding protein E (cbpE) | 47 | 17/294 | | 42, 186 |
| SP0943 | Gid protein (gid) | n.d. | n.d. | | 43, 187 |
| SP0952 | alanine dehydrogenase, authentic frameshift (ald) | n.d. | n.d. | | 44, 188 |
| SP1003 | conserved hypothetical protein (PAT) | n.d. | n.d. | | 45, 189 |
| SP1004 | Conserved hypothetical protein | n.d. | n.d. | | 46, 190 |
| SP1124 | glycogen synthase (glgA) | n.d. | n.d. | | 47, 191 |
| SP1154 | IgA1 protease | 28 | 13/470; 80missing | | 48, 192 |
| SP1174 | conserved domain protein (PAT) | n.d. | n.d. | | 49, 193 |
| SP1175 | conserved domain protein | n.d. | n.d. | | 50, 194 |

TABLE 3-continued

Gene distribution in S. pneumoniae strains.

| ORF | Common name | Gene distribution (present of 50) | Amino acid substitutions (in serotype 14 strain)* | Homology ( ) | Seq. ID (DNA, Prot.) |
|---|---|---|---|---|---|
| SP1221 | type II restriction endonuclease | n.d. | n.d. | | 51, 195 |
| SP1227 | DNA-binding response regulator | n.d. | n.d. | | 52, 196 |
| SP1241 | amino acid ABC transporter, amino acid-binding protein | 50 | 0/285 | | 53, 197 |
| SP1287 | signal recognition particle protein (ffh) | 49 | 0/300 | | 54, 198 |
| SP1330 | N-acetylmannosamine-6-P epimerase, putative (nanE) | 14 | 0/211# | | 55, 199 |
| SP1374 | Chorismate sythetase (aroC) | 50 | 0/289 | | 56, 200 |
| SP1378 | conserved hypothetical protein | n.d. | n.d. | | 57, 201 |
| SP1429 | peptidase, U32 family | 50 | 8/305 | | 58, 202 |
| SP1478 | oxidoreductase, aldo/keto reductase family | n.d. | n.d. | | 59, 203 |
| SP1518 | conserved hypothetical protein | 50 | 4/313; 3 additional | | 60, 204 |
| SP1522 | conserved domain protein | n.d. | n.d. | | 61, 205 |
| SP1527 | oligopeptide ABC transporter | 50 | 0/463 | | 62, 206 |
| SP1573 | lysozyme (lytC) | n.d. | n.d. | | 63, 207 |
| SP1604 | hypothetical protein | 50 | 3/138 | | 64, 208 |
| SP1661 | cell division protein DivIVA | 50 | 3/236 | | 65, 209 |
| SP1664 | ylmF protein (ylmF) | 50 | 0/164 | | 66, 210 |
| SP1676 | N-acetylneuraminate lyase, putative | n.d. | n.d. | | 67, 211 |
| SP1687 | neuraminidase B (nanB) | n.d. | n.d. | | 68, 212 |
| SP1693 | neuraminidase A (nanA) | n.d. | n.d. | | 69, 213 |
| SP1732 | serine/threonine protein kinase | 49 | 2/293 | | 70, 214 |
| SP1735 | methionyl-tRNA formyltransferase (fmt) | n.d. | n.d. | | 71, 215 |
| SP1759 | preprotein translocase, SecA subunit (secA-2) | n.d. | n.d. | | 72, 216 |
| SP1772 | cell wall surface anchor family protein | 23 | 12/253# | | 73, 217 |
| SP1804 | general stress protein 24, putative | n.d. | n.d. | | 74, 218 |
| SP1888 | oligopeptide ABC transporter, ATP-binding protein AmiE | n.d. | n.d. | | 75, 219 |
| SP1891 | oligopeptide ABC transporter, | n.d. | n.d. | | 76, 220 |
| SP1937 | Autolysin (lytA) | 50 | 0/275 | | 77, 221 |
| SP1954 | serine protease, subtilase family, authentic frame | 12 | 0/305# | | 78, 222 |
| SP1980 | cmp-binding-factor 1 (cbf1) | n.d. | n.d. | | 79, 223 |
| SP1992 | cell wall surface anchor family protein | 50 | 4/197 | | 80, 224 |
| SP1999 | catabolite control protein A (ccpA) | n.d. | n.d. | | 81, 225 |
| SP2021 | glycosyl hydrolase | n.d. | n.d. | | 82, 226 |
| SP2027 | Conserved hypothetical protein | n.d. | n.d. | | 83, 227 |
| SP2039 | conserved hypothetical protein | n.d. | n.d. | | 84, 228 |
| SP2048 | Conserved hypothetical protein | 50 | 8/134 | | 85, 229 |
| SP2051 | Conpetence protein CglC | 50 | 8/92 | | 86, 230 |
| SP2092 | UTP-glucose-1-phosphate uridylyltransferase (galU) | n.d. | n.d. | | 87, 231 |
| SP2099 | Penecillin binding protein 1B | n.d. | n.d. | | 88, 232 |
| SP2108 | Maltose ABC transporter | 50 | 1/279 | | 89, 233 |

TABLE 3-continued

Gene distribution in *S. pneumoniae* strains.

| ORF | Common name | Gene distribution (present of 50) | Amino acid substitutions (in serotype 14 strain)* | Homology ( ) | Seq. ID (DNA, Prot.) |
|---|---|---|---|---|---|
| SP2120 | hypothetical protein | n.d. | n.d. | | 90, 234 |
| SP2128 | transketolase, N-terminal subunit | n.d. | n.d. | | 91, 235 |
| SP2136 | choline binding protein PcpA | 45 | 1/382 | | 92, 236 |
| SP2141 | glycosyl hydrolase-related protein | n.d. | n.d. | | 93, 237 |
| SP2180 | conserved hypothetical protein | n.d. | n.d. | | 94, 238 |
| SP2190 | choline binding protein A (cbpA) | 47 | for: 48.8%; rev: 2/17# | | 95, 239 |
| SP2194 | ATP-dependent Clp protease, ATP-binding subunit | 50 | 1/262 | | 96, 240 |
| SP2201 | choline binding protein D (cbpD) | 50 | 7/384 | | 97, 241 |
| SP2204 | ribosomal protein L9 | n.d. | n.d. | | 98, 242 |
| SP2216 | secreted 45 kd protein - homology to glucan binding protein (GbpB) S. mutant | 50 | 0/347 | | 99, 243 |
| SP-NRF1 | Choline binding protein | n.d. | n.d. | | 100, 244 |
| ARF0408 | Hypothetical protein | n.d. | n.d. | | 101, 245 |
| ARF0441 | Hypothetical protein | n.d. | n.d. | | 102, 246 |
| ARF0690 | Hypothetical protein | n.d. | n.d. | | 103, 247 |
| ARF0878 | Hypothetical protein | n.d. | n.d. | | 104, 248 |
| ARF0921 | Hypothetical protein | n.d. | n.d. | | 105, 249 |
| ARF1153 | Hypothetical protein | n.d. | n.d. | | 106, 250 |
| ARF1515 | Hypothetical protein | n.d. | n.d. | | 107, 251 |
| ARF1519 | Hypothetical protein | n.d. | n.d. | | 108, 252 |
| ARF1905 | Hypothetical protein | n.d. | n.d. | | 109, 253 |
| ARF2044 | Hypothetical protein | n.d. | n.d. | | 110, 254 |
| ARF2155 | Hypothetical protein | n.d. | n.d. | | 111, 255 |
| ARF2199 | Hypothetical protein | n.d. | n.d. | | 112, 256 |
| CRF0129 | Hypothetical protein | n.d. | n.d. | | 113, 257 |
| CRF0200 | Hypothetical protein | n.d. | n.d. | | 114, 258 |
| CRF0236 | Hypothetical protein | n.d. | n.d. | | 115, 259 |
| CRF0394 | Hypothetical protein | n.d. | n.d. | | 116, 260 |
| CRF0408 | Hypothetical protein | n.d. | n.d. | | 117, 261 |
| CRF0430 | Hypothetical protein | n.d. | n.d. | | 118, 262 |
| CRF0498 | Hypothetical protein | n.d. | n.d. | | 119, 263 |
| CRF0519 | Hypothetical protein | n.d. | n.d. | | 120, 264 |
| CRF0573 | Hypothetical protein | n.d. | n.d. | | 121, 265 |
| CRF0713 | Hypothetical protein | n.d. | n.d. | | 122, 266 |

TABLE 3-continued

Gene distribution in S. pneumoniae strains.

| ORF | Common name | Gene distribution (present of 50) | Amino acid substitutions (in serotype 14 strain)* | Homology ( ) | Seq. ID (DNA, Prot.) |
|---|---|---|---|---|---|
| CRF0722 | Hypothetical protein | n.d. | n.d. | | 123, 267 |
| CRF0764 | Hypothetical protein | n.d. | n.d. | | 124, 268 |
| CRF1079 | Hypothetical protein | n.d. | n.d. | | 125, 269 |
| CRF1248 | Hypothetical protein | n.d. | n.d. | | 126, 270 |
| CRF1398 | Hypothetical protein | n.d. | n.d. | | 127, 271 |
| CRF1412 | Hypothetical protein | n.d. | n.d. | | 128, 272 |
| CRF1467.1 | Hypothetical protein | n.d. | n.d. | | 129, 273 |
| CRF1484 | Hypothetical protein | n.d. | n.d. | | 130, 274 |
| CRF1587 | Hypothetical protein | n.d. | n.d. | | 131, 275 |
| CRF1606 | Hypothetical protein | n.d. | n.d. | | 132, 276 |
| CRF1623 | Hypothetical protein | n.d. | n.d. | | 133, 277 |
| CRF1625 | Hypothetical protein | n.d. | n.d. | | 134, 278 |
| CRF1640 | Hypothetical protein | n.d. | n.d. | | 135, 279 |
| CRF1702 | Hypothetical protein | n.d. | n.d. | | 136, 280 |
| CRF1825 | Hypothetical protein | n.d. | n.d. | | 137, 281 |
| CRF1883 | Hypothetical protein | n.d. | n.d. | | 138, 282 |
| CRF1991 | Hypothetical protein | n.d. | n.d. | | 139, 283 |
| CRF1992 | Hypothetical protein | n.d. | n.d. | | 140, 284 |
| CRF2004 | Hypothetical protein | n.d. | n.d. | | 141, 285 |
| CRF2030 | Hypothetical protein | n.d. | n.d. | | 142, 286 |
| CRF2065 | Hypothetical protein | n.d. | n.d. | | 143, 287 |
| CRF2232 | Hypothetical protein | n.d. | n.d. | | 144, 288 |

TABLE 4

| ORF | Common Name | FACS | PK |
|---|---|---|---|
| ARF0878 | hypothetical protein | + | nd |
| ARF0921 | hypothetical protein | + | nd |
| CRF0236 | hypothetical protein | ++ | − |
| CRF0573 | hypothetical protein | + | nd |
| CRF1412 | hypothetical protein | + | nd |
| CRF1702 | hypothetical protein | + | nd |
| CRF1992 | hypothetical protein | ++ | ++ |
| SP0008 | hypothetical protein | + | − |
| SP0069 | Choline binding protein I | ++ | ++ |
| SP0082 | Cell wall surface anchor | + | − |
| SP0117 | pneumococcal surface protein A (pspA) | +++ | +++ |
| SP0212 | Ribosomal protein L2 | + | ++ |
| SP0295 | ribosomal protein S9 (rpsI) | ++ | +++ |
| SP0368 | cell wall surface anchor family protein | ++ | +++ |
| SP0369 | Penecillin binding protein 1A | ++ | ++ |
| SP0377 | Choline binding protein C | ++ | ++ |
| SP0378 | choline binding protein J (cbpJ) | ++ | nd |
| SP0390 | choline binding protein G (cbpG) | ++ | + |
| SP0454 | hypothetical protein | ++ | +++ |
| SP0463 | cell wall surface anchor family protein | + | ++ |
| SP0466 | sortase, putative | ++ | ++ |
| SP0468 | Sortase, putative | ++ | ++ |
| SP0519 | dnaJ protein (dnaJ) | ++ | + |
| SP0609 | amino acid ABC transporter, amino acid-bind | ++ | + |
| SP0641 | Serine protease | + | − |
| SP0664 | Zinc metalloprotease ZmpB | + | ++ |
| SP0749 | branched-chain amino acid ABC transporter | + | + |
| SP0770 | ABC transporter, ATP-binding protein | ++ | ++ |
| SP1154 | IgA1 protease | ++ | ++ |
| SP1287 | signal recognition particle protein (ffh) | + | ++ |
| SP1330 | N-acetylmannoseamine-6-P | ++ | − |
| SP1429 | peptidase, U32 family | + | ++ |
| SP1527 | oligopeptide ABC transporter | + | ++ |
| SP1759 | preprotein translocase, SecA subunit (wrong clone!!!) | + | − |
| SP1772 | cell wall surface anchor family protein | + | + |
| SP1891 | oligopeptide ABC transporter | + | ++ |
| SP1937 | Autolysin (lytA) | + | − |
| SP1954 | serine protease, subtilase family, auth frame | + | ++ |
| SP1980 | cmp-binding-factor 1 (cbf1) | + | − |
| SP2108 | Maltose ABC transporter | + | ++ |

TABLE 4-continued

| ORF | Common Name | FACS | PK |
|---|---|---|---|
| SP2136 | choline binding protein PcpA | + | ++ |
| SP2190 | choline binding protein A (cbpA) | + | ++ |
| SP2194 | ATP-dependent Clp protease, ATP-bind subu | ++ | ++ |
| SP2201 | choline binding protein D (cbpD) | + | ++ |
| SP2216 | secreted 45 kd protein | + | ++ |

SEQUENCE LISTING (318 sequences)

SEQ ID NO: 1 - DNA, 366 bp, Streptococcus pneumoniae
atgtctaaaaatattgtacaattgaataattcttttattcaaaatgaataccaacgtcgtcgctacctgatgaaagaacgacaaaaacggaatcgttttatgggaggggtattgattttgattatgctattatttatcttgccaacttttaatttagcgcagagttatcagcaattactccaaagacgtcagcaattagcagacttgcaaactcagtatcaaactttgagtgatgaaaaggataaggagacagcatttgctaccaagttgaaagatgaagattatgctgctaaatatacacgagcgaagtactattattctaagtcgagggaaaaagtttatacgattcctgacttgcttcaaagg

SEQ ID NO: 2 - DNA, 2631 bp, Streptococcus pneumoniae
atggataagaaaaaattattattgattgatgggtcttctgtagcttttcgggcgttttttgcgctgtatcagcagttggaccgttttaagaatgtggctggtttgcataccaatgcgatttatggttttcagttgatgttgagtcatttattggagcgggttgagccgagtcatattttggtggcttttgatgcgggaaagacgaccttccggacagagatgtatgcggactataagggtggtcgggccaagactcctgatgagtttcgtgagcaatttcctttcattcgtgagttgctggatcatatggggattcgtcactatgatctggctcagtatgaggcggatgacatcattgggacgctggataagctagcagagcaggatggttttgatattactattgtcagtggggacaaggatttgattcagctgacggatgagcatacggtggttgaaatttccaagaaaggtgtggctgagtttgaggcctttacgccagattacctcatggaagaaatgggcctcacaccagctcagtttatcgatctcaaggcgctcatgggtgataagtcggataatatccctggggtgaccaaagtcggtgaaaagacgggtattaagctcttgctggagcatggttcgcttgaggggatttatgaaaatattgatggaatgaagacttctaagatgaaggaaaatctcatcaatgacaaggaacaggcctttttgtctaaaacactagcgaccattgataccaaggcaccgattgcgattggtttagaggacttggtctatagtggtccagatgttgaaaatcttgggaaattctacgatgagatgggcttcaaacagctaaagcaggctttaaatgtgtcgtcagctgatgtgtctgagagtttggattttactattgttgaccaaatcagtcaagatatgctgagtgaagagtctatcttccactttgagctttttggtgagaattaccatacggataatttggttggatttgtctggtcttgtggggataagctctatgccacagacaagcttgagctgttgcaagacccgattttcaaggatttcttagaaaaaacatctctgagagtttatgactttaagaaggttaaagttcttttgcaacgttttggtgtggatttgcaggcgcctgcttttgacatccgtttggctaaatacctcctttcgactgtggaggacaatgaaattgcgaccatcgctagtctttatggtcagacttacttggttgatgatgaaactttctacggtaagggtgttaaaaaggccattcctgaacgtgagaaattcttggaacacttagcttgtaaacttgctgttttggtagaaacagagcctattttacttgaaaaactcagcgaaaatgggcaattagagcttctttatgatatggagcaacctctggcttttgtccttgccaagatggaaattgctgggattatggtcaagaaagagaccttgcttgagatgcaggctgaaaatgagcttgtcattgaaaaactgactcaagagatttacgagctggctggtgaggagtttaatgtcaactcgcctaagcagttgggcgtgcttctctttgagaaattgggacttcctctagaatacactaagaaaaccaagacaggttattcgacagcagtggatgttttagagcgtctcgctcctattgctccgattgttaagaaaatcctggattaccgtcaaattgctaagattcaatctacttatgtaattggcttgcaggactggattttggctgatggaaagattcatactcgctatgtgcaggatttgacccagaccgggcgtttgtctagtgtggatccaaacttgcaaaatattcctgcccgattggaacaggggcgcttgattcggaaggcttttgtgccagagtgggaggatagtgtgctactcagctctgactattcacagattgaattgcgcgttttggcgcatatttctaaggatgagcacttgattaaggccttccaagagggggcagatatccatacttcgacagccatgcgggtctttggcattgagcgtcctgatgatgtgactgcaaacgaccgtcgcaatgccaaggcagttaactttggagtggtttatgggatttcagactttggcttgtctaataatttgggaattagtcgtaaggaagccaaagcctacattgatacctactttgaacgttttccaggtattaaaaactacatggatgaagtggtgcgggaggcgcgtgataagggctatgtagagaccctctttaagcgtcgccgtgagttgccagatatcaattcgcgcaacttcaatattcgtggttttgcggagcgaactgctatcaactcacctatccagggttcggcagcagatattctcaagattgccatgattcagctggataaagccttggttgcaggtggttatcagactaagatgctgttacaagtgcacgatgaaatcgtccttgaagtgcctaaatctgaattggtagagatgaaaaaattggtgaaacaaaccatggaagaagccattcaactcagtgttcctcttatcgcagatgagaatgaaggggcaacctggtacgaggctaaa

SEQ ID NO: 3 - DNA, 633 bp, Streptococcus pneumoniae
atggggatggcagcttttaaaaatcctaacaatcaatacaaagctattacaattgctcaaactctaggtgatgatgcttcttcagaggaattggctggtagatatggttctgctgttcagtgtacagaagtgactgcctcaaacctttcaacagttaaaactaaagctacggttgtagaaaaaccactgaaagattttagagcgtctacgtctgatcagtctggttgggtggaatctaatggtaaatggtatttctatgagtctggtgatgtgaagacaggttgggtgaaaacagatggtaaatggtactatttgaatgacttaggtgtcatgcagactggatttgtaaaattttctggtagctggtattacttgagcaattcaggtgctatgtttacaggctggggaacagatggtagcagatggttctactttgacggctcaggagctatgaagacaggctggtacaaggaaaatggcacttggtattaccttgacgaagcaggtatcatgaagacaggttggtttaaagtcggaccacactggtactatgcctacggttcaggagctttggctgtgagcacaacaacaccagatggttaccgtgtaaatggtaatggtgaatgggtaaac

SEQ ID NO: 4 - DNA, 5568 bp, Streptococcus pneumoniae
atgagccgaaaaagcattggtgagaaacgccatagtttctcgatgagaaagttgtcagtgggattggtatcagttactgtatctagtttctttttgatgagtcaagggattcaatcggtatcggccgataatatggaaagtccaattcattataagtatatgaccgagggtaaattgacagacgaggaaaaatccttgctggtagaggcccttccacaactggctgaagaatcagatgatacttattacttggtttatagatctcaacagtttttaccgaatacaggttttaacccaactgttggtactttcctttttactgcaggattgagcttgttagttttattggtttctaaaagggaaaatggaaagaaacgacttgttcattttctgctgttgactagcatgggagttcaattgttgccggccagtgcttttgggttgaccagccagattttatctgcctataatagtcagctttctatcggagtcggggaacatttaccagagcctctgaaaatcgaaggttatcaatatattggttatatcaaaactaagaaacaggataatacagagctttcaaggacagttgatgggaaatactctgctcaaagagatagtcaaccaaactctacaaaaacatcagatgtagttcattcagctgatttagaatggaaccaaggacaggggaaggttagtttacaaggtgaagcatcaggggatgatggactttcagaaaaatcttctatagcagcagacaatctatcttctaatgattcattcgcaagtcaagttgagcagaatccggatcacaaaggagaatctgtagttcgaccaacagtgccagaacaaggaaatcctgtgtctgctacaacggtgcagagtgcggaagaggaagtattggcgacgacaaatgatcgaccagagtataaacttccattggaaaccaaaggcacgcaagaacccggtcatgagggtgaagccgcagtccgtgaagacttaccagtctacactaagccactagaaaccaaaggtacacaaggacccggacatgaaggtgaagctgcagttcgcgaggaagaaccagcttacacagaaccgttagcaacgaaaggcacgcaagagccaggtcatgagggcaaagctacagtccgcgaagagactctagagtacacggaaccggtagcgacaaaaggcacacaagaacccgaacatgagggcgaagcggcagtagaagaagaacttccggctttagaggtcactacacgaaatagaacggaaatccagaatattccttatacaacagaagaaattcaggatccaacacttctgaaaaatcgtcgtaagattgaacgacaagggcaagcagggacacgtacaattcaatatgaagactacatcgtaaatggtaatgtcgtagaaactaaagaagtgtcacgaactgaagtagctccggtcaacgaagtcgttaaagtaggaacacttgtgaaagttaaacctacagtagaaattacaaacttaacaaaagttgagaacaaaaaatctataactgtaagttataacttaatagacactacctcagcatatgtttctgcaaaaacgcaagttttccatggagacaagctagttaaagaggtggatatagaaaatcctgccaaagagcaagtaatatcaggtttagattactacacaccgtatacagttaaaacacacctaacttataatttgggtgaaaataatgaggaaaatactgaaacatcaactcaagatttccaattagagtataagaaaatagagattaaagatattgattcagtagaattatacggtaaagaaaatgatcgttatcgtagatatttaagtctaagtgaagcgccgactgatacggctaaatactttgtaaaagtgaaatcagatcgcttcaaagaaatgtacctacctgtaaaatctattacagaaaatacggatggaacgtataaagtgacggtagccgttgatcaacttgtcgaagaaggtacagacggttacaaagatgattacacatttactgtagctaaatctaaagcagagcaaccaggagtttacacatcctttaaacagctggtaacagccatgcaaagcaatctgtctggtgtctatacattggcttcagatatgaccgcagatgaggtgagcttaggcgataagcagacaagttatctcacaggtgcatttacagggagcttgatcggttctgatggaacaaaatcgtatgccatttatgatttgaagaaaccattatttgatacattaaatggtgctacagttagagatttggatattaaaactgtttctgctgatagtaaagaaaatgtcgcagcgctggcgaaggcagcgaatagcgcgaatattaataatgttgcagtagaaggaaaaatctcaggtgcgaaatctgttgcgggattagtagcgagcgcaacaaatacagtgatagaaaacagctcgtttacagggaaacttatcgcaaatcaccaggacagtaataaaaatgatactggaggaatagtaggtaatataacaggaaatagttcgagagttaataaagttagggtagatgccttaatctctactaatgcacgcaataataaccaaacagctggagggatagtaggtagattagaaaatggtgcattgatatctaattcggttgctactggagaaatacgaaatggtcaaggatattctagagtcggaggaatagtaggatctacgtggcaaaacggtcgagtaaataatgttgtgagtaacgtagatgttggagatggttatgttatcaccggtgatcaatacgcagcagcagatgtgaaaaatgcaagtacatcagttgataatagaaaagcagacagattcgctacaaaattatcaaaagaccaaatagacgcgaaagttgctgattatggaatcacagtaactcttgatgatactgggcaagatttaaaacgtaatctaagagaagttgattatacaagactaaataaagcagaagctgaaagaaaagtagcttatagcaacatagaaaaactgatgccattctacaataaagacctagtagttcactatggtaacaaagtagcgacaacagataaactttacactacagaattgttagatgttgtgccgatgaaagatgatgaagtagtaacggatattaataataagaaaaattcaataaataaagttatgttacatttcaaagataatacagtagaatacctagatgtaacattcaaagaaaacttcataaacagtcaagtaatcgaatacaatgttacaggaaaagaatatatattcacaccagaagcatttgtttcagactatacagcgataacgaataacgtactaagcgacttgcaaaatgtaacacttaactcagaagctactaaaaaagtactaggagcagcgaatgatgcagccttagataacctatacttagatagacaatttgaagaagttaaagctaatatagcagaacacctaagaaaagtattagcgatggataaatcaatcaatactacaggagacggtgtagttgaatacgtaagtgagaaaatcaaaaataacaaagaagcatttatgctaggtcttacttatatgaaccgttggtacgatattaattatggtaaaatgaatacaaaagatttatctacgtacaagtttgactttaacggaaataatgagacttcaacgttggatactattgtcgcattaggaaatagtggactagataacctgagagcttcaaatactgtaggtttatatgcgaataaacttgcatcggtaaaaggagaagattcagtctttgacttcgtagaagcgtatagaaaactgttcttaccaaacaaaacaaataacgagtggtttaaagaaaatacaaaggcatatatagtcgaaatgaagtctgatattgcagaagtacgagaaaaacaagaatcaccaacagccgatagaaaatattcattaggagtttacgatagaatatcagcaccaagttgggggcataagagtatgttattaccactactaactttacctgaagaatctgtgtatatttcatcgaatatgtctacacttgcattcggttcgtatgaaagatatcgtgatagtgtggatggagttattctttcaggagatgctttacgaacttatgtaagaaatagagttgatatagcagcgaaaaggcatagagaccattatgatatttggtacaatcttcttgacagtgcttcaaaagaaaaacttttccgttctgtgatagtttatgatggattcaatgtaaaagatgagacaggaagaacttattgggcaaggttaacggataaaaacatcggctctattaaagaattcttcggacctgttgggaaatggtatgagtataatagtagtgcaggagcgtatgcgaatggaagtttaacgcactttgtgttagatagattattagatgcttatggaacgtcggtttatactcatgaaatggttcataattctgattctgcaatctactttgaaggaaatggtagacgtgaaggattgggagcggagttatacgcacttggtttactgcaatctgtagatagtgtaaattctcatattttagctttaaatacgttatataaagcagaaaaagatgatttgaatagattgcatacatataatccggtggaacgtttcgattcggatgaggcgcttcaaagttatatgcatggatcatatgatgtaatgtatacacttgatgcgatggaagcaaaagcgatattagctcaaaataatgatgttaagaaaaaatggtttagaaaaatagaaaattattacgttcgtgatactagacataataaagatacacatgcaggaaataaagtccgtccattaacagatgaagaagtagctaacttaacatcgttaaactcattaatcgacaacgacatcataaatagacgtagctatgatgatagtagagaatataaacgaaatggctactatactataagtatgttctctcctgtatacgcagcgctaagcaattcgaaaggtgctcctggagatattatgtttagaaaaatagcttatgaattacttgcggaaaaaggttatcacaaaggattcctaccttatgtttctaatcagtacggagcagaagcatttgccagcggaagcaaaacattctcatcatggcatggaagagatgttgctttagtgacagatgatttagtatttaagaaagtattcaatggtgagtactcatcatgggctgatttcaaaaaagcaatgtttaaacaacgtatagataaacaagataatctgaaaccaataacaattcaatacgaattaggtaatcctaatagtacaaaagaagtaactataacaacggctgcacaaatgcaacaattaattaatgaagcggctgcgaaagatattactaatatagatcgtgcaacgagtcataccccagcaagttgggtgcatttattaaaacaaaaaatctataatgcatatcttcgcactacagatgactttagaaattctatatataaa

SEQ ID NO: 5 - DNA, 2571 bp, Streptococcus pneumoniae
atgaaattcaatccaaatcaaagatatactcgttggtctattcgccgtctcagtgtcggtgttgcctcagttgttgtggctagtggcttctttgtcctagttggtcagccaagttctgtacgtgccgatgggctcaatccaaccccaggtcaagtcttacctgaagagacatcgggaacgaaagagggtgacttatcagaaaaaccaggagacaccgttctcactcaagcgaaacctgagggcgttactggaaatacgaattcacttccgacacctacagaaagaactgaagtgagcgaggaaacaagcccttctagtctggatacactttttgaaaaagatgaagaagctcaaaaaaatccagagctaacagatgtcttaaaagaaactgtagatacagctgatgtggatgggacacaagcaagtccagcagaaactactcctgaacaagtaaaaggtggagtgaaagaaaatacaaaagacagcatcgatgttcctgctgcttatcttgaaaaagctgaagggaaaggtcctttcactgccggtgtaaaccaagtaattccttatgaactattcgctggtgatggtatgttaactcgtctattactaaaagcttcggataatgctccttggtctgacaatggtactgctaaaaatcctgctttacctcctcttgaaggattaacaaaagggaaatacttctatgaagtagacttaaatggcaatactgttggtaaacaaggtcaagctttaattgatcaacttcgcgctaatggtactcaaacttataaagctactgttaaagtttacggaaataaagacggtaaagctgacttgactaatctagttgctactaaaaatgtagacatcaacatcaatggattagttgctaaagaaacagttcaaaaagccgttgcagacaacgttaaagacagtatcgatgttccagcagcctacctagaaaaagccaagggtgaaggtccattcacagcaggtgtcaaccatgtgattccatacgaactcttcgcaggtgatggcatgttgactcgtctcttgctcaaggcatctgacaaggcaccatggtcagataacggcgacgctaaaaacccagccctatctccactaggcgaaaacgtgaagaccaaaggtcaatacttctatcaagtagccttggacggaaatgtagctggcaaagaaaaacaagcgctcattgaccagttccgagcaaatggtactcaaacttacagcgctacagtcaatgtctatggtaacaaagacggtaaaccagacttggacaacatcgtagcaactaaaaaagtcactattaacataaacggtttaatttctaaagaaacagttcaaaaagccgttgcagacaacgttaaagacagtatcgatgttccagcagcctacctagaaaaagccaagggtgaaggtccattcacagcaggtgtcaaccatgtgattccatacgaactcttcgcaggtgatggtatgttgactcgtctcttgctcaaggcatctgacaaggcaccatggtcagataacggtgacgctaaaaacccagccctatctccactaggtgaaaacgtgaagaccaaaggtcaatacttctatcaattagccttggacggaaatgtagctggcaaagaaaaacaagcgctcattgaccagttccgagcaaacggtactcaaacttacagcgctacagtcaatgtctatggtaacaaagacggtaaaccagacttggacaacatcgtagcaactaaaaaagtcactattaacataaacggtttaatttctaaagaaacagttcaaaaagccgttgcagacaacgttaaggacagtatcgatgttccagcagcctacctagaaaaggccaagggtgaaggtccattcacagcaggtgtcaaccatgtgattccatacgaactcttcgcaggtgatggcatgttgactcgtctcttgctcaaggcatctgacaaggcaccatggtcagataacggcgacgctaaaaacccagctctatctccactaggtgaaaacgtgaagaccaaaggtcaatacttctatcaagtagccttggacggaaatgtagctggcaaagaaaaacaagcgctcattgaccagttccgagcaaacggtactcaaacttacagcgctacagtcaatgtctatggtaacaaagacggtaaaccagacttggacaacatcgtagcaactaaaaaagtcactattaagataaatgttaaagaaacatcagacacagcaaatggttcattatcaccttctaactctggttctggcgtgactccgatgaatcacaatcatgctacaggtactacagatagcatgcctgctgacaccatgacaagttctaccaacacgatggcaggtgaaaacatggctgcttctgctaacaagatgtctgatacgatgatgtcagaggataaagctatgctaccaaatactggtgagactcaaacatcaatggcaagtattggtttccttgggcttgcgcttgcaggtttactcggtggtctaggtttgaaaaacaaaaaagaagaaaac

SEQ ID NO: 6 - DNA, 585 bp, Streptococcus pneumoniae
atgaaatcaataactaaaaagattaaagcaactcttgcaggagtagctgccttgtttgcagtatttgctccatcatttgtatctgctcaagaatcatcaacttacactgttaaagaaggtgatacactttcagaaatcgctgaaactcacaacacaacagttgaaaaattggcagaaaacaaccacattgataacattcatttgatttatgttgatcaagagttggttatcgatggccctgtagcgcctgttgcaacaccagcgccagctacttatgcggcaccagccgctcaagatgaaactgtttcagctccagtagcagaaactccagtagtaagtgaaacagttgtttcaactgtaagcggatctgaagcagaagccaaagaatggatcgctcaaaaagaatcaggtggtagctatacagctacaaatggacgttatatcggacgttaccaattaacagattcatacctgaacggtgactactcagctgaaaaccaagaacgtgtagcagatgcctacgttgcaggacgttacggttcatggactgctgctaaaaacttctggcttaacaatggctggtat

SEQ ID NO: 7 - DNA, 2232 bp, Streptococcus pneumoniae
atgaataagaaaaaaatgattttaacaagtctagccagcgtcgctatcttaggggctggttttgttacgtctcagcctacttttgtaagagcagaagaatctccacaagttgtcgaaaaatcttcattagagaagaaatatgaggaagcaaaagcaaaagctgatactgccaagaaagattacgaaacggctaaaaagaaagcagaagacgctcagaaaaagtatgaagatgatcagaagagaactgaggagaaagctcgaaaagaagcagaagcatctcaaaaattgaatgatgtggcgcttgttgttcaaaatgcatataaagagtaccgagaagttcaaaatcaacgtagtaaatataaatctgacgctgaatatcagaaaaaattaacagaggtcgactctaaaatagagaaggctaggaaagagcaacaggacttgcaaaataaatttaatgaagtaagagcagttgtagttcctgaaccaaatgcgttggctgagactaagaaaaaagcagaagaagctaaagcagaagaaaaagtagctaagagaaaatatgattatgcaactctaaaggtagcactagcgaagaaagaagtagaggctaaggaacttgaaattgaaaaacttcaatatgaaatttctactttggaacaagaagttgctactgctcaacatcaagtagataatttgaaaaaacttcttgctggtgcggatcctgatgatggcacagaagttatagaagctaaattaaaaaaaggagaagctgagctaaacgctaaacaagctgagttagcaaaaaaacaaacagaacttgaaaaacttcttgacagccttgatcctgaaggtaagactcaggatgaattagataaagaagcagaagaagctgagttggataaaaaagctgatgaacttcaaaataaagttgctgatttagaaaaagaaattagtaaccttgaaatattacttggaggggctgatcctgaagatgatactgctgctcttcaaaataaattagctgctaaaaaagctgagttagcaaaaaaacaaacagaacttgaaaaacttcttgacagccttgatcctgaaggtaagactcaggatgaattagataaagaagcagaagaagctgagttggataaaaaagctgatgaacttcaaaataaagttgctgatttagaaaaagaaattagtaaccttgaaatattacttggaggggctgattctgaagatgatactgctgctcttcaaaataaattagctactaaaaaagctgaattggaaaaaactcaaaaagaattagatgcagctcttaatgagttaggccctgatggagatgaagaagaaactccagcgccggctcctcaaccagagcaaccagctcctgcaccaaaaccagagcaaccagctccagctccaaaaccagagcaaccagctcctgcaccaaaaccagagcaaccagctccagctccaaaaccagagcaaccagctccagctccaaaaccagagcaaccagctaagccggagaaaccagctgaagagcctactcaaccagaaaaaccagccactccaaaaacaggctggaaacaagaaaacggtatgtggtatttctacaatactgatggttcaatggcaataggttggctccaaaacaacggttcatggtactacctaaacgctaacggcgctatggcaacaggttgggtgaaagatggagatacctggtactatcttgaagcatcaggtgctatgaaagcaagccaatggttcaaagtatcagataaatggtactatgtcaacagcaatggcgctatggcgacaggctggctccaatacaatggctcatggtactacctcaacgctaatggtgatatggcgacaggatggctccaatacaacggttcatggtattacctcaacgctaatggtgatatggcgacaggatgggctaaagtcaacggttcatggtactacctaaacgctaacggtgctatggctacaggttgggctaaagtcaacggttcatggtactacctaaacgctaacggttcaatggcaacaggttgggtgaaagatggagatacctggtactatcttgaagcatcaggtgctatgaaagcaagccaatggttcaaagtatcagataaatggtactatgtcaatggcttaggtgcccttgcagtcaacacaactgtagatggctataaagtcaatgccaatggtgaatgggtt

SEQ ID NO: 8 - DNA, 567 bp, Streptococcus pneumoniae
atgaaaaaaatagttcttgttagtctagctttcctttttgtcctggttggttgcggacagaaaaaagaaactggaccagctacaaaaacagaaaaagatacgcttcagtcggcattgccagttattgaaaatgctgagaagaatacagttgtaactaagactttggtcttgcccaagtcagatgatggtagccagcagacacaaacaattacttacaaagacaagacttttttgagtctagctatccaacaaaaacgtccagtctctgatgagttgaagacttatattgaccaacatggagtggaggaaactcaaaaagctcttcttgaagcggaggagaaggataagtctatcattgaagctcgtaaattggcaggtttcaaacttgaaacaaaactattgagcgcaacggaacttcaaacaacgactagttttgattttcaagttctggatgtcaagaaggcttcccagttggaacatctgaagaatattggtttggaaaatcttttgaaaaatgaaccaagcaaatatatttcagatagattggcaaatggcgcgacagaacaa

SEQ ID NO: 9 - DNA, 1248 bp, Streptococcus pneumoniae
atgtttgaagtagaagaatggctccatagtcggattggtttgaattttcgatcaggtttgggtcgaatgcagcaagcggtggatttgttaggaaatcctgagcagtcttaccctattatccacgtaacagggactaatgggaaaggatctaccattgcttttatgagggaattatttatggggcatggcaaaaaagttgcgacctttacctcccctcatatcgtctctatcaatgaccgaatctgcattaatgggcagcctatagcagacgcagactttatccgtttgactgatcaggtcaaggagatggagaaaacgcttctgcaaactcctgcccagttgtccttttttgaattgctgaccttggttgcttttctttattttagggagcaggaggtggatttggttttattagaagtgggaattggtggcttacttgacacgaccaatgtggtaactggagagtttgctgtcatcacctccattgggcttgaccatcaagaaaccttgggtgatagtctagaagcaattgcagagcagaaagctggtattttcaaggctggtaagaaggcagtgattgcgaaattgcctccagaagctaggcttgcctgtcagaaaaaagccgaatctttagctgttaacctttatcaggcaggtcaagattttttaatgctgaatggtgatttttcaagctctttactaaatctttcacagctgaacataggcttagaaggagtctatcagcaggagaatgcagccttggcgttgcaaacttttcttctttttatgagagaaagaaaggaagctgttgatgaacaggctgtaagaaaggccttggaacagacccattgggctggtcgcttggagcgtattcgcccacagatttatttggatggtgctcataacctccctgccttgactcgcttggctgagtttatcaaagaaaaagagcaggaaggctatcgacctcaaatcctctttggatccttgaaacgtaaggattatcaagggatgttgggttatctgactgaaaaattgcctcaggtggaactcaaggtgaccggctttgactatcagggggctttggacgaaagggatgtgacaggttacgatatagtttcttcttaccgagaatttatcagcgattttgaagaaagggcagacgctcaagacttgctgttcgttacagggtctctctattttatctcagaagtacggggctacctgctggaccgtgagcagataaat

SEQ ID NO: 10 - DNA, 831 bp, Streptococcus pneumoniae
gtgggaattcgtgtttataaaccaacaacaaacggtcgccgtaatatgacttctttggatttcgctgaaatcacaacaagcactcctgaaaaatcattgcttgttgcattgaagagcaaggctggtcgtaacaacaacggtcgtatcacagttcgtcaccaaggtggtggacacaaacgtttctaccgtttggttgacttcaaacgtaataaagacaacgttgaagcagttgttaaaacaatcgagtacgatccaaaccgttctgcaaacatcgctcttgtacactacactgacggtgtgaaagcatacatcatcgctccaaaaggtcttgaagtaggtcaacgtatcgtttcaggtccagaagcagatatcaaagtcggaaacgctcttccacttgctaacatcccagttggtactttgattcacaacatcgagttgaaaccaggtcgtggtggtgaattggtacgtgctgctggtgcatctgctcaagtattgggttctgaaggtaaatatgttcttgttcgtcttcaatcaggtgaagttcgtatgattcttggaacttgccgtgctacagttggtgttgtcggaaacgaacaacatggacttgtaaaccttggtaaagcaggacgtagccgttggaaaggtatccgcccaacagttcgtggttctgtaatgaaccctaacgatcacccacacggtggtggtgaaggtaaagcaccagttggtcgtaaagcaccatctactccatggggcaaacctgctcttggtcttaaaactcgtaacaagaaagcgaaatctgacaaacttatcgttcgtcgtcgcaacgagaaa

SEQ ID NO: 11 - DNA, 267 bp, Streptococcus pneumoniae
atggctaaaaaatcaatggtagctagagaggctaaacgccaaaaaattgttgaccgttatgctgaaaaacgtgctgcattaaaggcggcaggggactacgaaggtttatctaaattacctcgcaacgcctcaccgactcgtttacataatcgttgtagggttacggggcgcccacattcagtttaccgcaaatttggtctgagtcgtatcgcttttcgcgaacttgcgcataaaggtcaaattcctggtgtaacaaaagcatcttgg

SEQ ID NO: 12 - DNA, 1335 bp, Streptococcus pneumoniae
atggatattagacaagttactgaaaccatcgccatgattgaggagcaaaacttcgatattagaaccattaccatggggatttctcttttggactgtatcgatccagatatcaatcgtgctgcggagaaaatctatcaaaaaattacgacaaaggcggctaatttagtagctgttggtgatgaaattgcggctgagttgggaattcctatcgttaataagcgtgtatcggtgacacctatttctctgattggggcagcgacagatgcgacggactacgtggttctggcaaaagcgcttgataaggctgcgaaagagattggtgtggactttattggtggtttttctgccttagtacaaaaaggttatcaaaagggagatgagattctcatcaattccattcctcgcgctttggctgagacggataaggtctgctcgtcagtcaatatcggctcaaccaagtctggtattaatatgacggctgtggcagatatgggacgaattatcaaggaaacagcaaatctttcagatatgggagtggccaagttggttgtattcgctaatgctgttgaggacaatccatttatggcgggtgcctttcatggtgttggggaagcagatgttatcatcaatgtcggagtttctggtcctggtgttgtgaaacgtgctttggaaaaagttcgtggacagagctttgatgtagtagccgaaacagttaagaaaactgcctttaaaatcactcgtatcggtcaattggttggtcaaatggccagtgagagactgggtgtggagtttggtattgtggacttgagtttggcaccaacccctgcggttggagactctgtggcacgtgtccttgaggaaatggggctagaaacagttggcacgcatggaacgacggctgccttggccctcttgaacgaccaagttaaaaagggtggagtgatggcctgcaaccaagtcggtggtttatctggtgcctttatccctgtttctgaggatgaaggaatgattgctgcagtgcaaaatggctctcttaatttagaaaaactagaagctatgacggctatctgttctgttggattggatatgattgccatcccagaagatacgcctgctgaaactattgcggctatgattgcggatgaagcagcaatcggtgttatcaacatgaaaacaacagctgttcgtatcattcccaaaggaaaagaaggcgatatgattgagtttggtggtctattaggaactgcacccgttatgaaggttaatggggcttcgtctgtcgacttcatctctcgcggtggacaaatcccagcaccaattcatagttttaaaaat

SEQ ID NO: 13 - DNA, 2436 bp, Streptococcus pneumoniae
atggtaaatacagaagtagcaagaacaacaatcaagacagaatattttggcagccttactgaaaggatgaacaaatatcgagaagatgttttaaataaaaaaccttatattgatgctgagagagcagttctagcaacacgcgcctatgaacgatacaaggaacaacctaatgtcctaaaacgtgcatatatgctgaaagaaattttggaaaatatgactatctatattgaagaagaatctatgattgcgggaaatcaagcttcttccaataaagatgctcctatttttccggaatatacgctagaatttgttctcaatgagttggatctttttgaaaagcgtgatggagatgttttctatattacagaagaaacaaaagaacaacttagaagtattgctccgttttgggaaaataataatttacgtgctagagctggtgccttattacctgaagaagtgtctgtttatatggaaacaggattcttcggtatggaaggtaagatgaattctggagatgctcacttagcagttaactatcagaaacttttgcaatttggtttaagaggttttgaagagcgggctcgtaaagcaaaagtagctctagatttaacagatccagcaagtattgataaatatcatttttacgactctatatttatcgtaatcgatgctattaaagtatatgcaaagcgctttgttgctcttgctaaaagtttagccgaaaatgcaaatcctaaacgtaagaaagaattacttgagattgcagatatttgctctagagtcccatatgaaccggcaactacttttgcagaagctattcaatcagtttggtttattcaatgtattttacaaattgaatctaatggccactctctttcatatggccgttttgatcaatatatgtatccatatatgaaggctgatttagaaagtggtaaagaaacagaagatagcattgttgaacgtctgacaaatctttggattaagacaattacaattaataaggttcgcagtcaatcacatacattttcttcagcaggaagtcctttatatcaaaatgttacaattggtggacagactcgagataagaaggatgctgttaacccattatcttatttggtattaaaatcagttgcacaaacccatctaccgcaacctaatctaactgtacgttaccatgcaggtttagatgctcgtttcatgaatgagtgtattgaagtgatgaaacttggttttggtatgcctgcatttaataatgatgagattattattccttcttttattgcaaaaggagtattggaagatgatgcttatgattacagtgccattggatgtgttgaaacggcagttccagggaaatggggctatcgttgcacaggtatgagttatatgaacttccctaaggttctacttatcacgatgaatgatggaattgatccggcttcgggtaaacggtttgcaccaagctttggtcgttttaaggatatgaagaacttttctgaattagaaaatgcttgggataaaacactaagatatttgacacgaatgagtgttattgttgaaaattctattgatttatcattggaacgagaagttcctgatattctatgttcagcattgactgatgattgtattggtcgtggaaaacaccttaaagaaggtggagcagtatatgattatatatcaggattgcaagttggaattgcaaatttgtcggattcattagctgcaattaaaaaattggtgtttgaggaagaacgtataagcccaagtcagctttggcatgcactggaaacagattatgccggagaagaaggtaaggtcattcaagaaatgttgattcatgatgcacctaagtatggtaatgatgatgattatgctgacaaattggttactgctgcttatgacatttatgttgatgaaattgctaaatatcctaatacacgttatggaagagggcctattggaggaattcgttattcaggaacatcttctatctcagccaacgtagggcagggacgtggaacattagcaactccagatggacgcaacgcgggtacaccgttagcagagggttgttcaccatcacataatatggatcaacacggccctacatctgttttaaaatctgtttcaaaattaccaacagatgaaatcgtaggtggggttctcttaaatcagaaagtaaatcctcaaacgttagccaaagaagaagataaattaaaactaattgctttgttacgaacattctttaatcgtttacatgggtaccatattcaatacaatgttgtttccagagagacgctgattgacgctcagaaacatcctgaaaaacacagagacttaattgttcgtgttgcaggatactctgcattcttcaatgttctttctaaggcaacccaagatgacattataggacgtactgagcatactttg

SEQ ID NO: 14 - DNA, 390 bp, Streptococcus pneumoniae
atgtcacaagcacaatatgcaggtactggacgtcgtaaaaacgctgttgcacgcgttcgccttgttccaggaactggtaaaatcactgttaacaaaaaagatgttgaagagtacatcccacacgctgaccttcgtcttgtcatcaaccaaccattcgcagttacttcaactgtaggttcatacgacgttttcgttaacgttataggtggtggatacgctggtcaatcaggagctatccgtcacggtatcgctcgtgcccttcttcaagtagacccagacttccgcgattcattgaaacgcgcaggacttcttacacgtgactcacgtaaagttgaacgtaagaaaccaggtcttaagaaagctcgtaaagcatcacaatttagtaaacgt

SEQ ID NO: 15 - DNA, 999 bp, Streptococcus pneumoniae
ttggagaagaaactgaccataaaagacattgcggaaatggctcagacctcgaaaacaaccgtgtcattttacctaaacgggaaatatgaaaaaatgtcccaagagacacgtgaaaagattgaaaaagttattcatgaaacaaattacaaaccgagcattgttgcgcgtagcttaaactccaaacgaacaaaattaatcggtgttttgattggtgatattaccaacagtttctcaaaccaaattgttaagggaattgaggatatcgccagccagaatggctaccaggtaatgataggaaatagtaattacagccaagagagtgaggaccggtatattgaaagcatgcttctcttgggagtagacggctttattattcagccgacctctaatttccgaaaatattctcgtatcatcgatgagaaaaagaagaaaatggtcttttttgatagtcagctctatgaacaccggactagctgggttaaaaccaataactatgatgccgtttatgacatgacccagtcctgtatcgaaaaaggttatgaacattttctcttgattacagcggatacgagtcgtttgagtactcggattgagcgggcaagtggttttgtggatgctttaacagatgctaatatgcgtcacgccagtctaaccattgaagataagcatacgaatttggaacaaattaaggaatttttacaaaaagaaatcgatcccgatgaaaaaactctggtatttatccctaactgttgggccctacctctagtctttaccgttatcaaagagttgaattataacttgccacaagttgggttgattggttttgacaatacggagtggacttgcttttcttctccaagtgtttcgacgctggttcagccctcctttgaggaaggacaacaggctacaaagattttgattgaccagattgaaggtcgcaatcaagaagaaaggcaacaagtcttggattgtagtgtgaattggaaagagtcgactttc

SEQ ID NO: 16 - DNA, 5301 bp, Streptococcus pneumoniae
atgaataaaggattatttgaaaaacgttgtaaatatagtattcggaaattttcattaggtgttgcttctgttatgattggagctgcattctttgggacaagtccggttcttgcagatagcgtgcagtctggttccacggcgaacttaccagctgatttagctactgctcttgcaacagcaaaagagaatgatgggcgtgattttgaagcgcctaaggtgggagaagaccaaggttctccagaagttacagatggacctaagacagaagaagaactattagcacttgaaaaagaaaaaccggctgaagaaaaaccaaaagaggataaacctgcagctgctaaacctgaaacacctaagacggtaacccctgaatggcaaacggtagcgaataaagagcaacagggaacagtcactatccgagaagaaaaaggtgtccgctacaaccaactatcctcaactgctcaaaatgataacgcaggcaaaccagccctgtttgaaaagaagggcttgaccgttgatgccaatggaaatgcaactgttgatttaaccttcaaagatgattctgaaaagggcaaatcacgctttggtgtctttttgaaatttaaagataccaagaataatgtttttgtcggttatgacaaggatggctggttctgggagtataaatctccaacaactagcacttggtatagaggtagtcgtgttgctgctcctgaaacaggatcaacaaaccgtctctctatcactctcaagtcagacggtcagctaaatgccagcaataatgatgtcaatctctttgacacagtgactctaccagctgcggtcaatgaccatcttaaaaatgagaagaagattcttctcaaggcgggctcttatgacgatgagcgaacagttgttagcgttaaaacggataaccaagagggggtaaaaacagaggatacccctgctgaaaaagaaacaggtcctgaagttgatgatagcaaggtgacttatgacacgattcagtctaaggtcctcaaagcagtgattgaccaagccttccctcgtgtcaaggaatacagcttgaacgggcatactttgccaggacaggtgcaacagttcaaccaagtctttatcaataaccaccgaatcacccctgaagtcacttataagaaaatcaatgagacaacagcagagtacttgatgaagcttcgcgatgatgctcacttaatcaatgcggaaatgacagtacgcttgcaagttgtagacaatcaattgcactttgatgtgactaagattgtcaaccacaatcaagtcactccaggtcaaaagattgatgacgaaagcaaactactttcttctattagtttcctcggcaatgctttagtctctgtttctagtaatcaaactggtgctaagtttgatggggcaaccatgtcaaacaatacgcatgtcagcggagatgatcatatcgatgtaaccaatccaatgaaggatttggctaagggttacatgtatggatttgtttctacagataagcttgctgctggtgtttggagtaactctcaaaacagctatggtggtggttcgaatgactggactcgtttgacagcttataaagaaacagtcggaaatgccaactatgtaggaatccacagctctgaatggcaatgggaaaaagcttataagggcattgttttcccagaatacacgaaggaacttccaagtgctaaggttgttatcactgaagatgccaatgcagacaagaacgttgattggcaagatggtgccattgcttatcgtagcattatgaacaatcctcaaggttgggaaaaagttaaggatatcacagcttaccgtatcgcgatgaactttggttctcaagcacaaaacccattccttatgaccttggatggtatcaagaaaatcaatctccatacagatggtcttgggcaaggtgttctccttaaaggatatggtagcgaaggccatgactctggtcacttgaactatgctgatattggtaagcgtatcggtggtgtcgaagacttcaagaccctaattgagaaggctaagaaatatggagctcatctaggtatccacgttaacgcttcagaaacttatcctgagtctaaatacttcaatgaaaaaattctccgtaagaatccagatggaagctatagctatggttggaactggctagatcaaggtatcaacattgatgctgcctatgacctagctcatggtcgtttggcacgttgggaagatttgaagaaaaaacttggtgacggtctcgactttatctatgtggacgtttggggtaatggtcaatcaggtgataacggtgcctgggctacccacgttcttgctaaagaaattaacaaacaaggctggcgctttgcgatcgagtggggccatggtggtgagtacgactctaccttccatcactgggcagctgacttgacctacggtggctacaccaataaaggtatcaacagtgccatcacccgctttatccgtaaccaccaaaaagatgcttgggtaggggactacagaagttatggtggtgcagccaactatccactgctaggtggctacagcatgaaagactttgaaggctggcagggaagaagtgactacaatggctatgtaaccaacttatttgcccatgacgtcatgactaagtacttccaacacttcactgtaagtaaatgggaaaatggtacaccggtgactatgaccgataacggtagcacctataaatggactccagaaatgcgagtggaattggtagatgctgacaataataaagtagttgtaactcgtaagtcaaatgatgtcaatagtccacaatatcgcgaacgtacagtaacgctcaacggacgtgtcatccaagatggttcagcttacttgactccttggaactgggatgcaaatggtaagaaactttctactgataaggaaaagatgtactacttcaatacgcaggccggtgcaacaacttggacccttccaagcgattgggcaaagagcaaggtttacctttacaagctaactgaccaaggtaagacagaagagcaagaactaactgtaaaagatggtaaaattaccctagatcttctagcaaatcaaccatacgttctctatcgttcgaaacaaactaatcctgaaatgtcatggagtgaaggcatgcacatctatgaccaaggatttaatagcggtaccttgaaacattggaccatttcaggcgatgcttctaaggcagaaattgtcaagtctcaaggggcaaacgatatgcttcgtattcaaggaaacaaagaaaaagttagtctcactcagaaattaactggcttgaaaccaaataccaagtatgccgtttatgttggtgtagataaccgtagtaatgccaaggcaagtatcactgtgaatactggtgaaaaagaagtgactacttataccaataagtctctcgcgctcaactatgttaaggcctacgcccacaatacacgtcgtgacaatgctacagttgacgatacaagttacttccaaaacatgtacgccttctttacaactggagcggacgtctcaaatgttactctgacattgagtcgtgaagctggtgatcaagcaacttactttgatgaaattcgtacctttgaaaacaattcaagcatgtacggagacaagcatgatacaggtaaaggcaccttcaagcaagactttgaaaatgttgctcagggtatcttcccatttgtagtgggtggtgtcgaaggtgttgaagataaccgcactcacttgtctgaaaaacacaatccatatacacaacgtggttggaatggtaagaaagtcgatgatgttatcgaaggaaattggtcactcaagacaaatggactagtgagccgtcgtaacttggtttaccaaaccatcccacaaaacttccgttttgaagcaggtaagacctaccgtgtaacctttgaatacgaagcaggatcagacaatacctatgcttttgtagtcggtaagggagaattccagtcaggtcgtcgtggtactcaagcaagcaacttggaaatgcatgaattgccaaatacttggacagattctaagaaagccaagaaggcaaccttccttgtgacaggtgcagaaacaggcgatacttgggtaggtatctactcaactggaaatgcaagtaatactcgtggtgattctggtggaaatgccaacttccgtggttataacgacttcatgatggataatcttcaaatcgaagaaattaccctaacaggtaagatgttgacagaaaatgctctgaagaactacttgccaacggttgccatgactaactacaccaaagagtctatggatgctttgaaagaggcggtctttaacctcagtcaggccgatgatgatatcagtgtggaagaagcgcgtgcagagattgccaagattgaagctttgaagaatgctttggttcagaagaagacggctttggtagcagatgactttgcaagtcttacagctcctgctcaggctcaagaaggtcttgcaaatgcctttgatggcaatgtgtctagtctatggcatacatcttggaatggtggagatgtaggcaagcctgcaactatggtcttgaaagaaccaactgaaatcacaggacttcgctatgttccgcgtggatcaggttcaaatggtaacttgcgagatgtgaaacttgttgtgacagatgagtctggcaaggagcatacctttactgcaactgattggccaaataacaacaaaccaaaagatattgactttggtaagacaatcaaggctaagaaaattgtccttactggtaccaagacatacggagatggtggagataaataccaatctgcagcggaacttatctttactcgtccacaggtagcagaaacacctcttgacttgtcaggctatgaagcagctttggttaaggctcagaaattaacagacaaagacaatcaagaggaagtagctagcgttcaggcaagcatgaaatatgcgacggataaccatctcttgacggaaagaatggtggaatactttgcagattatctcaaccaattaaaagattctgctacgaaaccagatgctccaactgtagagaaacctgagtttaaacttagatctttagcttccgagcaaggtaagacgccagattataagcaagaaatagctagaccagaaacacctgaacaaatcttgccagcaacaggtgagagtcaatctgacacagccctcatcctagcaagtgttagtctagccctatctgctctctttgtagtaaaaacgaagaaagac

SEQ ID NO: 17 - DNA, 2157 bp, Streptococcus pneumoniae
atgaacaaaccaacgattctgcgcctaatcaagtatctgagcattagcttcttaagcttggttatcgcagccattgtcttaggcggaggagtttttttctactacgttagcaaggctcctagcctatccgagagtaaactagttgcaacaacttctagtaaaatctacgacaataaaaatcaactcattgctgacttgggttctgaacgccgcgtcaatgcccaagctaatgatattcccacagatttggttaaggcaatcgtttctatcgaagaccatcgcttcttcgaccacagggggattgataccatccgtatcctgggagctttcttgcgcaatctgcaaagcaattccctccaaggtggatcaactctcacccaacagttgattaagttgacttacttttcaacttcgacttccgaccagactatttctcgtaaggctcaggaagcttggttagcgattcagttagaacaaaaagcaaccaagcaagaaatcttgacctactatataaataaggtctacatgtctaatgggaactatggaatgcagacagcagctcaaaactactatggtaaagacctcaataatttaagtttacctcagttagccttgctggctggaatgcctcaggcaccaaaccaatatgacccctattcacatccagaagcagcccaagaccgccgaaacttggtcttatctgaaatgaaaaatcaaggctacatctctgctgaacagtatgagaaagcagtcaatacaccaattactgatggactacaaagtctcaaatcagcaagtaattaccctgcttacatggataattacctcaaggaagtcatcaatcaagttgaagaagaaacaggctataacctactcacaactgggatggatgtctacacaaatgtagaccaagaagctcaaaaacatctgtgggatatttacaatacagacgaatacgttgcctatccagacgatgaattgcaagtcgcttctaccattgttgatgtttctaacggtaaagtcattgcccagctaggagcacgccatcagtcaagtaatgtttccttcggaattaaccaagcagtagaaacaaaccgcgactggggatcaactatgaaaccgatcacagactatgctcctgccttggagtacggtgtctacgattcaactgctactatcgttcacgatgagccctataactaccctgggacaaatactcctgtttataactgggataggggctactttggcaacatcaccttgcaatacgccctgcaacaatcgcgaaacgtcccagccgtggaaactctaaacaaggtcggactcaaccgcgccaagactttcctaaatggtctaggaatcgactacccaagtattcactactcaaatgccatttcaagtaacacaaccgaatcagacaaaaaatatggagcaagtagtgaaaagatggctgctgcttacgctgcctttgcaaatggtggaacttactataaaccaatgtatatccataaagtcgtctttagtgatgggagtgaaaaagagttctctaatgtcggaactcgtgccatgaaggaaacgacagcctatatgatgaccgacatgatgaaaacagtcttgacttatggaactggacgaaatgcctatcttgcttggctccctcaggctggtaaaacaggaacctctaactatacagacgaggaaattgaaaaccacatcaagacctctcaatttgtagcacctgatgaactatttgctggctatacgcgtaaatattcaatggctgtatggacaggctattctaaccgtctgacaccacttgtaggcaatggccttacggtcgctgccaaagtttaccgctctatgatgacctacctgtctgaaggaagcaatccagaagattggaatataccagaggggctctacagaaatggagaattcgtatttaaaaatggtgctcgttctacgtggaactcacctgctccacaacaacccccatcaactgaaagttcaagctcatcatcagatagttcaacttcacagtctagctcaaccactccaagcacaaataatagtacgactaccaatcctaacaataatacgcaacaatcaaatacaacccctgatcaacaaaatcagaatcctcaaccagcacaacca

SEQ ID NO: 18 - DNA, 1392 bp, Streptococcus pneumoniae
atgagtaaaaaaagacgaaatcgtcataaaaaagaaggtcaagaaccgcaatttgattttgatgaagcaaaagagctaacagttggtcaagctattcgtaaaaatgaagaagtggaatcaggagtcttgcctgaggattccattttggacaagtatgttaagcaacacagagatgaaattgaggcggataagtttgcgactcgtcaatacaaaaaagaggagttcgttgaaactcagagtctggatgatttaattcaagagatgcgtgaggctgtagagaagtcagaagcttcttcggaggaagttccatcttctgaagacatcttactacccttgcctctggacgatgaggagcaaggcttggatcctctattgctagatgatgaaaatccaacagaaatgactgaagaagtggaagaggagcaaaacctttctcgtctggatcaagaggactcagaaaagaaaagtaaaaaaggctttattttgaccgttttggcgcttgtatcagtaattatttgtgtcagtgcttattatgtctaccgtcaagtggctcgttcgactaaggaaattgaaacttctcaatcaactacagccaatcaatcggatgtggatgattttaatacactttatgacgccttttacacagatagcaataaaacggctttgaaaaatagccagtttgataaactgagtcaactcaagactttacttgataagctggaaggtagtcgtgaacatacgcttgccaaatctaaatatgatagtctagcaacgcaaatcaaggctattcaagatgtcaatgctcaatttgagaaaccagctattgtggatggtgtgttggataccaatgccaaagccaaatcggatgctaaatttacggatattaaaactggaaatacggagcttgataaagtgctagataaggctatcagtcttggtaagagccagcaaacaagtacttctagctcaagttcaagtcaaactagcagctcaagttcaagtcaagcaagttcaaatacgactagtgagccaaaaccaagtagttcaaatgagactagaagtagtcgcagtgaagtcaatatgggtctctcgagtgcaggggttgctgttcaaagaagtgccagtcgtgttgcctataatcagtctgctattgatgatagtaataactctgcctgggattttgcggatggtgtcttggaacaaattctagcgacttcacgttcacgtggctatatcactggagaccaatatatccttgaacgtgtcaatatcgttaacggcaatggttattacaacctctacaagccagatggaacctatctctttacccttaactgtaagacaggctactttgtcggaaatggcgctggtcatgcggatgacttagattac

SEQ ID NO: 19 - DNA, 1020 bp, Streptococcus pneumoniae
atgaagcttttgaaaaaaatgatgcaagtcgcattagcagtctttttctttggtttgctagctacaaatacggtatttgcgaataccacaggtggccgatttgttgataaggataatagaaaatattatgtaaaagatgatcataaagcaatctattggcataaaatagacggtaaaacttactattttggtgatattggagagatggttgtcggttggcaatacttagaaattcctggaacaggttatcgtgataatttattcgataaccaaccagttaatgaaattggccttcaggagaagtggtactattttggacaagatggtgctttgctagaacaaacagataaacaagtactagaggcaaaaacgtctgaaaatacaggaaaagtatacggtgaacaatatcctctatctgctgaaaagagaacttattattttgataataattatgctgtaaagacaggctggatttatgaagagggtcattggtattatttaaataagctaggaaattttggcgatgattcttacaatccactaccaattggtgaagttgctaagggttggactcaagattttcatgttactattgacattgatagaagcaaacctgctccatggtactacctagatgcttcaggtaagatgcttacagattggcaaaaagtaaacggaaaatggtattattttggctcctctggttctatggcaacaggttggaaatatgtacgaggcaaatggtattacttagataataaaaatggtgatatgaaaacaggatggcaataccttggtaacaagtggtactacctccgttcatcaggagctatggtaactggctggtatcaagatggttcaacttggtactatttagatccttctaatggagatatgaaaataggttggacaaaagtaaatggaaaatggtattatctcaattcaaatggagcaatggttacaggtagccaaactatcgatggtaaagtttataatttcgcctcatctggtgagtggatt

SEQ ID NO: 20 - DNA, 996 bp, Streptococcus pneumoniae
atgaaaattttgaaaaaaactatgcaagttggactgacagtatttttctttggtttgctagggaccagtacagtatttgcagatgattctgaaggatggcagtttgtccaagaaaacggaagaacctactacaaaaagggggacctcaaagaaacctactggcgagtgattgatggtaagtactattattttgattctctatctggagagatggttgtcggctggcaatatatcccgtttccatctaaaggtagtacaattggtccttacccaaatggtatcagattagaaggttttccaaagtcagagtggtactacttcgataaaaatggagtgctacaagagtttgttggttggaaaacattagagattaaaactaaagacagtgttggaagaaagtacggggaaaaacgtgaagattcagaagataaagaagagaagcgttattatacgaactattactttaatcaaaatcattctttagagacaggttggctttatgatcagtctaactggtattatctagctaagacggaaattaatggagaaaactaccttggtggtgaaagacgtgcggggtggataaacgatgattcgacttggtactacctagatccaacaactggtattatgcaaacaggttggcaatatctaggtaataagtggtactacctccgttcctcaggagcaatggccactggctggtatcaggaaggtaccacttggtattatttagaccacccaaatggcgatatgaaaacaggttggcaaaaccttgggaacaaatggtactatctccgttcatcaggagctatggcaactggttggtatcaagatggttcaacttggtactacctaaatgcaggtaatggagacatgaagacaggttggttccaggtcaatggcaactggtactatgcttatagctcaggtgctttggcagtgaatacgaccgtagatggctattctgtcaactataatggcgaatgggttcgg

SEQ ID NO: 21 - DNA, 855 bp, Streptococcus pneumoniae
atggttttatctaagtattatggagtagccgatggaatgaatgtagaagggaggggaagtgcgaattttattaaagataatgtgttaattacagcggctcacaactactacagacatgactatgggaaagaagcggatgatatttatgttcttccggctgttagtccaagtcaagaaccatttggaaagatcaaagtaaaggaagttcgttatttgaaggaatttagaaatttaaattctaaggatgcaagggaatatgacttggctttattaattctagaagagcccattggtgcaaaattagggactttgggtcttcctactagtcaaaaaaatttgacaggaataactgtgactatcacaggctatccatcatataattttaaaattcatcaaatgtatacagataaaaaacaagttttaagtgatgatggcatgttcttggattaccaagttgatactttagaggggtctagtggatctacagtttatgatgctagtcaccgtgtagtaggagtgcatactttaggagatggagctaatcaaattaacagtgcagttaaattaaatgaacgaaatttgccatttatttattcggttcttaaaggttactctcttgaaggatggaagaaaataaatggtagttggtaccattatagacaacatgataaacaaacgggttggcaggagataaatgatacttggtattatttagacagttccggtaagatgcttacagattggcaaaaagtaaatggaaaatggtattatctcaattcaaatggagcaatggttacaggtagccaaactatcgatggtaaagtttataacttcgcttcatctggtgagtggatt

SEQ ID NO: 22 - DNA, 1890 bp, Streptococcus pneumoniae
ttgatgaaaaaaacttttttcttactggtgttaggcttgttttgccttcttccactctctgtttttgccattgatttcaagataaactcttatcaaggggatttgtatattcatgcagacaatacggcagagtttagacagaagatagtttaccagtttgaggaggactttaagggccaaatcgtgggacttggacgtgctggtaagatgcctagcgggtttgacattgaccctcatccaaagattcaggccgcgaaaaacggtgcagaactagcagatgtgactagcgaagtaacagaagaagcggatggttatactgtgagagtctataatccaggtcaggagggcgacatagttgaagttgacctcgtctggaacttaaaaaatttacttttcctttatgatgatatcgctgaattaaattggcaacctctgacagatagttcagagtctattgaaaagtttgaatttcatgtaaggggagacaagggggctgaaaaactctttttccatacagggaaactttttagagagggaacgattgaaaagagtaaccttgattatactatccgtttagacaatcttccggctaagcgtggagttgagttgcatgcctattggcctcggaccgattttgctagcgctagggatcagggattgaaagggaatcgtttagaagagtttaataagatagaagactcgattgttagagaaaaagatcagagtaaacaactcgttacttgggtcctcccttcgatcctttccatctccttgttattgagtgtctgcttctattttatttatagaagaaagaccactccttcagtcaaatatgccaaaaatcatcgtctctatgaaccaccaatggaattagagcctatggttttatcagaagcagtctactcgacctccttggaggaagtgagtcccttggtcaagggagctggaaaattcacctttgatcaacttattcaagctaccttgctagatgtgatagaccgtgggaatgtctctatcatttcagaaggagatgcagttggtttgaggctagtaaaagaagatggtttgtcaagctttgagaaagactgcctaaatctagctttttcaggtaaaaaagaagaaactctttccaatttgtttgcggattacaaggtatctgatagtctttatcgtagagccaaagtttctgatgaaaaacggattcaagcaagagggcttcaactcaaatcttcttttgaagaggtattgaaccagatgcaagaaggagtgagaaaacgagtttccttctgggggctcccagattattatcgtcctttaactggtggggaaaaggccttgcaagtgggtatgggtgccttgactatcctgcccctatttatcggatttggtttgttcttgtacagtttagacgttcatggctatctttacctccctttgccaatacttggttttctagggttagttttgtctgttttctattattggaagcttcgactagataatcgtgatggtgttctaaatgaagcgggagctgaggtctactatctctggaccagttttgaaaatatgttgcgtgagattgcacgattggatcaggctgaactggaaagtattgtggtctggaatcgcctcttggtctatgcgaccttatttggctatgcggacaaggttagtcatttgatgaaggttcatcagattcaagtggaaaatccagatatcaatctctatgtagcttatggctggcacagtacgttttatcattcaacagcacaaatgagccattatgctagtgtcgcaaatacagcaagcacctactctgtatcttctggaagtggaagttctggtggtggcttctctggaggcggaggtggcggcagtatcggtgccttt

SEQ ID NO: 23 - DNA, 1995 bp, Streptococcus pneumoniae
atgaaatcaatcaacaaatttttaacaatgcttgctgccttattactgacagcgagtagcctgttttcagctgcaacagtttttgcggctgggacgacaacaacatctgttaccgttcataaactattggcaacagatggggatatggataaaattgcaaatgagttagaaacaggtaactatgctggtaataaagtgggtgttctacctgcaaatgcaaaagaaattgccggtgttatgttcgtttggacaaatactaataatgaaattattgatgaaaatggccaaactctaggagtgaatattgatccacaaacatttaaactctcaggggcaatgccggcaactgcaatgaaaaaattaacagaagctgaaggagctaaatttaacacggcaaatttaccagctgctaagtataaaatttatgaaattcacagtttatcaacttatgtcggtgaagatggagcaaccttaacaggttctaaagcagttccaattgaaattgaattaccattgaacgatgttgtggatgcgcatgtgtatccaaaaaatacagaagcaaagccaaaaattgataaagatttcaaaggtaaagcaaatccagatacaccacgtgtagataaagatacacctgtgaaccaccaagttggagatgttgtagagtacgaaattgttacaaaaattccagcacttgctaattatgcaacagcaaactggagcgatagaatgactgaaggtttggcattcaacaaaggtacagtgaaagtaactgttgatgatgttgcacttgaagcaggtgattatgctctaacagaagtagcaactggttttgatttgaaattaacagatgctggtttagctaaagtgaatgaccaaaacgctgaaaaaactgtgaaaatcacttattcggcaacattgaatgacaaagcaattgtagaagtaccagaatctaatgatgtaacatttaactatggtaataatccagatcacgggaatactccaaagccgaataagccaaatgaaaacggcgatttgacattgaccaagacatgggttgatgctacaggtgcaccaattccggctggagctgaagcaacgttcgatttggttaatgctcagactggtaaagttgtacaaactgtaactttgacaacagacaaaaatacagttactgttaacggattggataaaaatacagaatataaattcgttgaacgtagtataaaagggtattcagcagattatcaagaaatcactacagctggagaaattgctgtcaagaactggaaagacgaaaatccaaaaccacttgatccaacagagccaaaagttgttacatatggtaaaaagtttgtcaaagttaatgataaagataatcgtttagctggggcagaatttgtaattgcaaatgctgataatgctggtcaatatttagcacgtaaagcagataaagtgagtcaagaagagaagcagttggttgttacaacaaaggatgctttagatagagcagttgctgcttataacgctcttactgcacaacaacaaactcagcaagaaaaagagaaagttgacaaagctcaagctgcttataatgctgctgtgattgctgccaacaatgcatttgaatgggtggcagataaggacaatgaaaatgttgtgaaattagtttctgatgcacaaggtcgctttgaaattacaggccttcttgcaggtacatattacttagaagaaacaaaacagcctgctggttatgcattactaactagccgtcagaaatttgaagtcactgcaacttcttattcagcgactggacaaggcattgagtatactgctggttcaggtaaagatgacgctacaaaagtagtcaacaaaaaaatcactatcccacaaacgggtggtattggtacaattatctttgctgtagcgggggctgcgattatgggtattgcagtgtacgcatatgttaaaaacaacaaagatgaggatcaacttgct

SEQ ID NO: 24 - DNA, 837 bp, Streptococcus pneumoniae
atggcggtaatggcgtatccgctggtgtctcgcttgtattatcgagtggaatcaaatcaacaaattgctgactttgataaggaaaaagcaacgttggatgaggctgacattgatgaacgaatgaaattggcacaagccttcaatgactctttgaataatgtagtgagtggcgatccttggtcggaagaaatgaagaaaaaagggcgagcagagtatgcacgtatgttagaaatccatgagcggatggggcatgtggaaatccccgttattgacgtggatttgccggtttatgctggtactgctgaagaggtattgcagcaaggggctgggcatctagagggaacttctctgccgatcggaggcaattcgacccatgcggtgattacggcacatacaggtttgccaacagctaagatgtttacggatttgaccaaacttaaagttggggataagttttatgtgcacaatatcaaggaagtgatggcctatcaagtggatcaagtaaaggtgattgagccgacgaactttgatgatttattgattgtaccaggtcatgattatgtgaccttgctgacttgtacgccatacatgatcaatacccatcgtctattggttcgggggcatcggataccgtacgtagcagaggttgaggaagaatttattgcagcaaacaaactcagtcatctctatcgctacctgttttatgtggcagttggtttgattgtgattcttttatggattattcgacgcttgcgcaagaagaaaaaacaaccggaaaaggctttgaaggcgctgaaagcagcaaggaaggaagtgaaggtggaggatggacaacag

SEQ ID NO: 25 - DNA, 849 bp, Streptococcus pneumoniae
atgtcaaggactaaactacgagccttattgggatacttgttgatgttggtagcctgtttgattcctatttattgttttggacagatggtgttgcagtctcttggacaggtgaaaggtcatgctacatttgtgaaatccatgacaactgaaatgtaccaagaacaacagaaccattctctcgcctacaatcaacgcttggcttcgcaaaatcgcattgtagatccttttttggcggagggatatgaggtcaattaccaagtgtctgacgaccctgatgcagtctatggttacttgtctattccaagtttggaaatcatggagccggtttatttgggagcagattatcatcatttagggatgggcttggctcatgtggatggtacaccgctgcctctggatggtacagggattcgctcagtgattgctgggcaccgtgcagagccaagccatgtctttttccgccatttggatcagctaaaagttggagatgctctttattatgataatggccaggaaattgtagaatatcagatgatggacacagagattattttaccgtcggaatgggaaaaattagaatcggttagctctaaaaatatcatgaccttgataacctgcgatccgattcctacctttaataaacgcttattagtgaattttgaacgagtcgctgtttatcaaaaatcagatccacaaacagctgcagttgcgagggttgcttttacgaaagaaggacaatctgtatcgcgtgttgcaacctctcaatggttgtaccgtgggctagtggtactggcatttctgggaatcctgtttgttttgtggaagctagcacgtttactacgagggaaa

SEQ ID NO: 26 - DNA, 4977 bp, Streptococcus pneumoniae
atgaagaatccattttttgaaagacgttgtcgttacagtattcgtaagttatcagtaggagcctgctcgctgatgattggtgctgttttatttgctggtccagccttggctgaagaaactgcagttcctgaaaatagcggagctaatacagagcttgtttcaggagagagtgagcattcgaccaatgaagctgataagcagaatgaaggggaacatgctagagaaaacaagctagaaaaggcagaaggagtagcgatagcatctgaaactgcttcgccagcaagcaatgaagctgcaactactgaaactgcagaagcagctagcgcagctaaaccagaggaaaaagcaagtgaggtggttgcagaaacaccatctgcagaagcaaaacctaagtctgacaaggaaacagaagcaaagcccgaagcaactaaccaaggggatgagtctaaaccagcagcagaagctaataagactgaaaaagaagtccagccagatgtccctaaaaatacagaaaaaacattaaaaccaaaggaaatcaaatttaattcttgggaagaattgttaaaatgggaaccaggtgctcgtgaagatgatgctattaaccgcggatctgttgtcctcgcttcacgtcggacaggtcatttagtcaatgaaaaagctagcaaggaagcaaaagttcaagccttatcaaacaccaattctaaagcaaaagaccatgcttctgttggtggagaagagttcaaggcctatgcttttgactattggcaatatctagattcaatggtcttctgggaaggtctcgtaccaactcctgacgttattgatgcaggtcaccgtaacggggttcctgtatacggtacactcttcttcaactggtctaatagtattgcagatcaagaaagatttgctgaagctttgaagcaagacgcagatggtagcttcccaattgcccgtaaattggtagacatggccaagtattatggctatgatggctatttcatcaaccaagaaacaactggagatttggttaaacctcttggagaaaagatgcgccagtttatgctctatagcaaggaatatgctgctaaggtaaaccatccaatcaagtattcttggtacgatgccatgacctataactatggacgttatcatcaagatggtttgggagaatacaactaccaattcatgcaaccagaaggagataaggttccggcagataacttctttgctaactttaactgggataaggctaaaaatgattacactattgcaactgccaactggattggtcgtaatccttatgatgtatttgcaggtttggaattgcaacagggtggttcctacaagacaaaggttaagtggaatgacattttagacgaaaatgggaaattgcgcctttctcttggtttatttgccccagataccattacaagtttaggaaaaactggtgaagattatcataaaaatgaagatatcttctttacaggttatcaaggagaccctactggccaaaaaccaggtgacaaagattggtatggtattgctaacctagttgcggaccgtacgccagcggtaggtaatacttttactacttcttttaatacaggtcatggtaaaaaatggttcgtagatggtaaggtttctaaggattctgagtggaattatcgttcagtatcaggtgttcttccaacatggcgctggtggcagacttcaacaggggaaaaacttcgtgcagaatatgattttacagatgcctataatggcggaaattcccttaaattctctggtgatgtagccggtaagacagatcaggatgtgagactttattctactaagttagaagtaactgagaagaccaaacttcgtgttgcccacaagggaggaaaaggttctaaagtttatatggcattctctacaactccagactacaaattcgatgatgcagatgcatggaaagagctaaccctttctgacaactggacaaatgaagaatttgatcttagctcactagcgggtaaaaccatctatgcagtcaaactatttttcgagcatgaaggtgctgtaaaagattatcagtttaacctaggacaattaactatctcggacaatcaccaagagccacaatcgccgacaagcttttctgtagtgaaacaatctcttaaaaatgcccaagaagcggaagcagttgtgcaatttaaaggcaacaaggatgcagatttctatgaagtttatgaaaaagatggagacagctggaaattactaactggctcatcttctacaactatttatctaccaaaagttagccgctcagcaagtgctcagggtacaactcaagaactgaaggttgtagcagtcggtaaaaatggagttcgttcagaagctgcaaccacaacctttgattggggtatgactgtaaaagataccagcctaccaaaaccactagctgaaaatatcgttccaggtgcaacagttattgatagtactttccctaagactgaaggtggagaaggtattgaaggtatgttgaacggtaccattactagcttgtcagataaatggtcttcagctcagttgagtggtagtgtggatattcgtttgaccaagccacgtaccgttgttagatgggtcatggatcatgcaggagctggtggtgagtctgttaacgatggcttgatgaacactaaagactttgacctttattataaagatgcagatggtgagtggaagctagctaaggaagtccgtggtaacaaagcacacgtgacagatatcactcttgataaaccaatcactgctcaagactggcgcttgaatgttgtcacttctgacaatggaactccatggaaggctattcgtatctataactggaaaatgtatgaaaagcttgatactgagagtgtcaatattccgatggccaaggctgcagcccgttctctaggcaataacaaggtacaagttggctttgcagatgtaccggctggagcaactattaccgtttatgataatccaaattctcaaactccgctcgcaaccttgaagagcgaagttggaggagacctagcaagtgcaccattggatttgacaaatcaatctggtcttctttattatcgtacccagttgccaggcaaggaaattagtaatgtcctagcagtttccgttccaaaagatgacagaagaatcaagtcagtcagcctagaaacaggacctaagaaaacaagctacgccgaaggggaggatttggaccttagaggtggtgttcttcgagttcagtatgaaggaggaactgaggacgaactcattcgcctaactcacgcaggtgtatcagtatcaggttttgatacgcatcataagggagaacagaatcttactctccaatatttgggacaaccggtaaatgctaatttgtcagtgactgtcactggccaagacgaagcaagtccgaaaactattttgggaattgaagtaagtcaggaaccgaaaaaagattacctagttggtgatagcttagacttgtctgaaggacgctttgcagtggcttatagcaatgacaccatggaagaacattcctttactgatgagggagttgaaatttctggttacgatgctcaaaagactggtcgtcaaaccttgacgcttcattaccaaggccatgaagttagctttgatgttttggtatctccaaaagcagcattgaacgatgagtacctcaaacaaaaattagcagaagttgaagctgctaagaacaaggtggtctataactttgcttcatcagaagtaaaagaagccttcttgaaagcaattgaagcggccgaacaagtgttgaaagaccatgaaactagcacccaagatcaagtcaatgaccgacttaataaattgacagaagctcataaagctctgaatggtcaagagaaatttacggaagaaaagacagagcttgatcgcttaacaggtgaggttcaagaactcttggctgccaaaccaaaccatccttcaggttctgccctagctccgcttcttgagaaaaacaaggccttggttgaaaaagtagatttgagtccagaagagcttacaacagcgaaacagagtctaaaagatctggttgctttattgaaagaagacaagccagcagtcttttctgatagtaaaacaggtgttgaagtacacttctcaaataaagagaagactgtcatcaagggtttgaaagtagagcgtgttcaagcaagtgctgaagagaagaaatactttgctggagaagatgctcatgtctttgaaatagaaggtttggatgaaaaaggtcaagatgttgatctctcttatgcttctattgtgaaaatcccaattgaaaaagataagaaagttaagaaagtatttttcttacctgaaggcaaagaggcagtagaattggcttttgaacaaacggatagtcatgttatctttacagcacctcactttactcattatgcctttgtttatgaatctgctgaaaaaccacaacctgctaaaccagcaccacaaaacacagtccttccaaaacctacttatcaaccgacttctgatcaacaaaaggctcctaaattggaagttcaagaggaaaaggttgcctttcatcgtcaagagcatgaaaatactgagatgctagttggggaacaacgagtcatcatacagggacgagatggactgttaagacatgtctttgaagttgatgaaaacggtcagcgtcgtcttcgttcaacagaagtcatccaagaagcgattccagaaattgttgaaattggaacaaaagtaaaaacagtaccagcagtagtagctacacaggaaaaaccagctcaaaatacagcagttaaatcagaagaagcaagcaaacaattgccaaatacaggaacagctgatgctaatgaagccctaatagcaggcttagccagccttggtcttgctagtttagccttgaccttgagacggaaaagagaagataaagat

SEQ ID NO: 27 - DNA, 1461 bp, Streptococcus pneumoniae
atgtcaattacatcatttgtaaaaagaattcaagatatcactcgaaacgatgctggtgttaatggtgatgctcaacgtattgagcaaatgtcttggttattattcttaaaaatttatgatagccgtgaaatggtttgggaattagaagaagacgagtatgagtcaattatcccagaggaattaaaatggcgaaattgggctcatgctcaaaatggggaacgggtattgacaggcgatgaattacttgattttgtcaataacaagttattcaaagagttgaaagagcttgaaataacttcaaatatgcctattcgaaaaacgattgttaaatcagcttttgaagatgcgaacaactatatgaaaaatggcgtcttgttacgccaagtcatcaatgttattgatgaagttgatttcaatagccctgaagatcgtcattcgtttaatgatatttacgaaaaaattcttaaagatattcaaaatgctgggaactcaggagaattttatacgccacgtgcagcgactgattttattgccgaagttcttgacccaaaacttggagaatcaatggcagaccttgcttgcggaacaggaggcttcttgacttcgactctgaaccgtttaagtagtcaacgtaaaactagtgaagataccaaaaaatataatacagctgtttttggtattgaaaagaaagcatttcctcatcttttagcagttacaaatctgtttcttcacgaaattgatgaccctaaaattgttcatggaaatactttggagaaaaatgttcgtgaatatacggatgatgaaaaatttgacattattatgatgaatccaccttttggagggtcagaattagaaacaataaaaaataactttccagcagaattacggagttctgaaacagctgatttatttatggctgtcattatgtatcgtttgaaagaaaatggtcgtgttggagttattttacctgatggttttctatttggtgaaggtgtaaaaactcgcttgaaacaaaaactggtagatgagttcaacttgcatacgattattaggttgcctcatagtgtctttgcaccgtatacaggaatccatacgaacattcttttctttgataaaacaaagaaaacagaagaaacttggttttatcgtttagatatgccagatggttataaaaatttctcgaaaactaagccgatgaagtcagaacacttcaatcctgttcgtgactggtgggaaaatcgtgaagagattctggaaggtaagttctacaaatctaaatcatttacacctagtgaattggctgagttgaattataatttagaccagtgtgactttccaaaagaggaagaggaaatcttaaatccctttgagttgattcagaattatcaagcggaaagagcaactttaaatcataagattgataatgtattagctgatattttgcagttgttggaggacaaa

SEQ ID NO: 28 - DNA, 1134 bp, Streptococcus pneumoniae
atgaacaatactgaattttatgatcgtctgggggtatccaaaaacgcttcggcagacgaaatcaaaaaggcttatcgtaagctttccaaaaaatatcacccagatatcaacaaggagcctggtgctgaggacaagtacaaggaagttcaagaagcctatgagactttgagtgacgaccaaaaacgtgctgcctatgaccagtatggtgctgcaggcgccaatggtggttttggtggagctggtggtttcggcggtttcaatggggcaggtggcttcggtggttttgaggatattttctcaagtttcttcggcggaggcggttcttcgcgcaatccaaacgctcctcgccaaggagatgatctccagtatcgtgtcaatttgacctttgaagaagctatcttcggaactgagaaggaagttaagtatcatcgtgaagctggctgtcgtacatgtaatggatctggtgctaagccagggacaagtccagtcacttgtggacgctgtcatggcgctggtgtcattaacgtcgatacgcagactcctcttggtatgatgcgtcgccaagtaacctgtgatgtctgtcacggtcgaggaaaagaaatcaaatatccatgtacaacctgtcatggaacaggtcatgagaaacaagctcatagcgtacatgtgaaaatccctgctggtgtggaaacaggtcaacaaattcgcctcgctggtcaaggtgaagcaggctttaacggtggaccttatggtgacttgtatgtagtagtttctgtggaagctagcgacaagtttgaacgtgaaggaacgactatcttctacaatctcaacctcaactttgtccaagcggctcttggtgatacagtagatattccaactgttcacggtgatgttgaattggttattccagagggaactcagactggtaagaagttccgcctacgtagtaagggggcaccgagccttcgtggcggtgcagttggtgaccaatacgttactgttaatgtcgtaacaccgacaggcttgaacgaccgccaaaaagtagccttgaaagaattcgcggctgctggtgacttgaaagtaaatccaaagaaaaaaggcttctttgaccatattaaagatgcctttgatggagaa

SEQ ID NO: 29 - DNA, 1359 bp, Streptococcus pneumoniae
atgaatcctaatctttttagaagcgtcgagttttatcagagacgttaccataactatgcgacagtgttaattatacctctttcattactatttactttcatcttgattttctcccttgttgccacaaaagaaattactgttacttcccaaggagaaatcgcccctacaagtgtcattgcctccattcagtcaaccagtgataatcctatcctagctaatcatttagtggcaaatcaagtagttgaaaaaggggacttactcatcaaatactctgaaacaatggaagaaagtcagaaaactgccttagcaactcaattacaaagacttgagaagcaaaaagaaggacttggaattttgaaacaaagcttagaaaaagcgactgatcttttttctggcgaggatgaatttggctaccataatacctttatgaattttactaaacaatcccatgatattgaactgggtatcacaaagactaacaccgaagtttcaaatcaagctaatctttccaatagcagttcatcagctattgaacaagaaattacaaaagttcaacaacaaattggagaatatcaagagttgagagatgctatcataaataacagagcacgcttaccaactggcaatccgcaccagtcaattttgaatcgttatcttgtagcctcacaaggacaaacacaaggaactgcagaggagccatttttatctcaaattaatcaaagtattgcaggtcttgaatcatctatcgcaagcctcaaaattcagcaagctggtatcggaagtgtagcaacttatgataacagtttagcaaccaaaattgaagtactccgcactcagtttttacagacagcctcacagcaacaactaactgtggagaatcaattaacagaattaaaagtacaactagatcaagccacacagcgtttggaaaacaataccttaacctccccaagtaaaggtatcgttcatctgaacagcgaatttgaaggtaaaaatagaattccaactggtacagaaattgctcaaatattccctgtcatcacagatacaagagaagtactaatcacttactacgtatcttctgactatctacctctactagataaaggacaaactgtaagattaaaactggagaagattggaaatcacggcaccaccatcatcggccaacttcagacaattgatcaaactcctaccagaacagagcaaggaaatctctttaaattaaccgctcttgcaaaactatctaacgaggatagtaaactcatccaatatggcttacaaggtcgcgtcactagtgtaactacaaagaaaacatattttgattatttcaaagataaaattttaacacattctgat

SEQ ID NO: 30 - DNA, 393 bp, Streptococcus pneumoniae
atgtcaaagaaactcaatcgtaaaaaacaattacgaaatggcctccgtcgcgcaggtgccttttcaagtacggtgactaaggttgtagatgagacaaaaaaagtcgtgaagcgtgcagaacagtcagcaagcgcagctggtaaggctgtttctaaaaaagttgaacaagcagtagaagctaccaaagagcaagctcaaaaagtagctaattctgtagaagattttgcagcaaatttgggtggacttccacttgatcgtgccaagactttctatgatgaaggaatcaagtctgcttcagatttcaaaaactggactgaaaaagaactccttgccttgaaaggaatcggcccagctaccatcaagaaattgaaagaaaatggcatcaagttcaag

SEQ ID NO: 31 - DNA, 762 bp, Streptococcus pneumoniae
ttgattagccttttcggccttgctgctgccaaaccagtccaggctgatacaagtatcgcagacattcaaaaaagaggcgaactggttgtcggtgtcaaacaagacgttcccaattttggttacaaagatcccaagaccggtacttattctggtatcgaaaccgacttggccaagatggtagctgatgaactcaaggtcaagattcgctatgtgccggttacagcacaaacccgcggcccccttctagacaatgaacaggtcgatatggatatcgcgacctttaccatcacggacgaacgcaaaaaactctacaactttaccagtccctactacacagacgcttctggatttttggtcaataaatctgccaaaatcaaaaagattgaggacctaaacggcaaaaccatcggagtcgcccaaggttctatcacccaacgcctgattactgaactgggtaaaaagaaaggtctgaagtttaaattcgtcgaacttggttcctacccagaattgattacttccctgcacgctcatcgtatcgataccttttccgttgaccgctctattctatctggctacactagtaaacggacagcactactagatgatagtttcaagccatctgactacggtattgttaccaagaaatcaaatacagagctcaacgactatcttgataacttggttactaaatggagcaaggatggtagtttgcagaaactttatgaccgttacaagctcaaaccatctagccatactgcagat

SEQ ID NO: 32 - DNA, 1659 bp, Streptococcus pneumoniae
atgagtaatatcagtttaacaacacttggtggtgtgcgtgagaatggaaaaaatatgtacattgctgaaattggagagtccatttttgttttgaatgtagggttaaaatatcctgaaaatgaacaattaggggtcgatgtggtgattccaaacatggattacctttttgaaaatagcgaccgtattgctggggttttcttgacccacgggcatgcggatgccattggtgctctaccgtatctcttggcagaggctaaagttcctgtatttgggtctgagttgaccattgagttggcaaagctctttgtcaaaggaaatgatgccgttaagaaatttaatgatttccatgtcattgatgagaatacggagattgattttggtgggacagtggtttccttcttccctacgacttactccgttccagagagtctgggaattgtcttgaagacatcggaaggaagcatcgtttatacaggtgacttcaaatttgaccaaacggctagtgaatcttatgcaactgattttgctcgtttggcagagattggtcgtgacggcgtcctggctctcctcagtgattcggccaatgcagacagcaatattcaggtggctagtgaaagtgaagttagggatgaaattacccaaactattgctgactgggaaggtcgtatcatcgttgcagctgtttccagtaatctttctcgtattcagcagatttttgacgctgcggataaaacaggtcgacgtatcgtcttgacaggatttgatattgaaaatatcgtccgcacagcgattcgtcttaagaagttgtctttagccaacgaaattcttttgattaagcctaaagatatgtctcgctttgaagaccatgagttgattattcttgagacaggtcgtatgggtgagcctatcaatggacttcgtaagatgtcgattggtcgccatcgttatgtagaaatcaaggatggggacctagtctatattgctacggctccgtctattgctaaagaagcctttgttgcgcgtgtggaaaatatgatttatcaggcaggtggggttgtcaaattgattacccaaagtttacatgtatcagggcacggaaatgtgcgtgatttgcagctgatgatcaatcttttgcaacctaagtacctcttccctgtccaaggggagtatcgtgagttggatgctcacgctaaggctgccatggcagttgggatgttgccagaacgcatcttcattcctaaaaaggggacgaccatggcttacgagaatggagactttgttccagctggatcggtttcagcaggagatatcttgattgatgggaatgccattggtgatgttggaaatgttgttcttcgtgaccgtaaggtcttgtcagaggatggaattttcatcgtggctattacagtcaaccgtcgtgagaagaaaattgtggctagggctcgtgttcacacgcgtggatttgtttatctcaagaagagtcgcgatattctccgtgaaagttcagaattgattaaccaaacggtagaagagtatcttcaaggagatgactttgactgggcagatctcaaaggtaaggttcgtgacaatctgaccaagtacctctttgatcaaaccaagcgtcgcccagccattttaccagtagtcatggaagcaaaa

SEQ ID NO: 33 - DNA, 6420 bp, Streptococcus pneumoniae
atgaaaaaaagtacagtattgtcattaaccacagctgcagttattttagcagcctatgcccctaatgaggtagtcttagcagacacatctagctctgaagatgctttaaacatctctgataaagaaaaagtagcagaaaataaagagaaacatgaaaatatccatagtgctatggaaacttcacaggattttaaagagaagaaaacagcagtcattaaggaaaaagaagttgttagtaaaaatcctgtgatagacaataacactagcaatgaagaagcaaaaatcaaagaagaaaattccaataaatcccaaggagattatacggactcatttgtgaataaaaacacagaaaatcccaaaaaagaagataaagttgtctatattgctgaatttaaagataaagaatctggagaaaaagcaatcaaggaactatccagtcttaagaatacaaaagttttatatacttatgatagaatttttaacggtagtgccatagaaacaactccagataacttggacaaaattaaacaaatagaaggtatttcatcggttgaaagggcacaaaaagtccaacccatgatgaatcatgccagaaaggaaattggagttgaggaagctattgattacctaaagtctatcaatgctccgtttgggaaaaattttgatggtagaggtatggtcatttcaaatatcgatactggaacagattatagacataaggctatgagaatcgatgatgatgccaaagcctcaatgagatttaaaaaagaagacttaaaaggcactgataaaaattattggttgagtgataaaatccctcatgcgttcaattattataatggtggcaaaatcactgtagaaaaatatgatgatggaagggattattttgacccacatgggatgcatattgcagggattcttgctggaaatgatactgaacaagacatcaaaaactttaacggcatagatggaattgcacctaatgcacaaattttctcttacaaaatgtattctgacgcaggatctgggtttgcgggtgatgaaacaatgtttcatgctattgaagattctatcaaacacaacgttgatgttgtttcggtatcatctggttttacaggaacaggtcttgtaggtgagaaatattggcaagctattcgggcattaagaaaagcaggcattccaatggttgtcgctacgggtaactatgcgacttctgcttcaagttcttcatgggatttagtagcaaataatcatctgaaaatgaccgacactggaaatgtaacacgaactgcagcacatgaagatgcgatagcggtcgcttctgctaaaaatcaaacagttgagtttgataaagttaacataggtggagaaagttttaaatacagaaatataggggcctttttcgataagagtaaaatcacaacaaatgaagatggaacaaaagctcctagtaaattaaaatttgtatatataggcaaggggcaagaccaagatttgataggtttggatcttaggggcaaaattgcagtaatggatagaatttatacaaaggatttaaaaaatgcttttaaaaaagctatggataagggtgcacgcgccattatggttgtaaatactgtaaattactacaatagagataattggacagagcttccagctatgggatatgaagcggatgaaggtactaaaagtcaagtgttttcaatttcaggagatgatggtgtaaagctatggaacatgattaatcctgataaaaaaactgaagtcaaaagaaataataaagaagattttaaagataaattggagcaatactatccaattgatatggaaagttttaattccaacaaaccgaatgtaggtgacgaaaaagagattgactttaagtttgcacctgacacagacaaagaactctataaagaagatatcatcgttccagcaggatctacatcttgggggccaagaatagatttacttttaaaacccgatgtttcagcacctggtaaaaatattaaatccacgcttaatgttattaatggcaaatcaacttatggctatatgtcaggaactagtatggcgactccaatcgtggcagcttctactgttttgattagaccgaaattaaaggaaatgcttgaaagacctgtattgaaaaatcttaagggagatgacaaaatagatcttacaagtcttacaaaaattgccctacaaaatactgcgcgacctatgatggatgcaacttcttggaaagaaaaaagtcaatactttgcatcacctagacaacagggagcaggcctaattaatgtggccaatgctttgagaaatgaagttgtagcaactttcaaaaacactgattctaaaggtttggtaaactcatatggttccatttctcttaaagaaataaaaggtgataaaaaatactttacaatcaagcttcacaatacatcaaacagacctttgacttttaaagtttcagcatcagcgataactacagattctctaactgacagattaaaacttgatgaaacatataaagatgaaaaatctccagatggtaagcaaattgttccagaaattcacccagaaaaagtcaaaggagcaaatatcacatttgagcatgatactttcactataggcgcaaattctagctttgatttgaatgcggttataaatgttggagaggccaaaaacaaaaataaatttgtagaatcatttattcattttgagtcagtggaagaaatggaagctctaaactccaacgggaagaaaataaacttccaaccttctttgtcgatgcctctaatgggatttgctgggaattggaaccacgaaccaatccttgataaatgggcttgggaagaagggtcaagatcaaaaacactgggaggttatgatgatgatggtaaaccgaaaattccaggaaccttaaataagggaattggtggagaacatggtatagataaatttaatccagcaggagttatacaaaatagaaaagataaaaatacaacatccctggatcaaaatccagaattatttgctttcaataacgaagggatcaacgctccatcatcaagtggttctaagattgctaacatttatcctttagattcaaatggaaatcctcaagatgctcaacttgaaagaggattaacaccttctccacttgtattaagaagtgcagaagaaggattgatttcaatagtaaatacaaataaagagggagaaaatcaaagagacttaaaagtcatttcgagagaacactttattagaggaattttaaattctaaaagcaatgatgcaaagggaatcaaatcatctaaactaaaagtttggggtgacttgaagtgggatggactcatctataatcctagaggtagagaagaaaatgcaccagaaagtaaggataatcaagatcctgctactaagataagaggtcaatttgaaccgattgcggaaggtcaatatttctataaatttaaatatagattaactaaagattacccatggcaggtttcctatattcctgtaaaaattgataacaccgcccctaagattgtttcggttgatttttcaaatcctgaaaaaattaagttgattacaaaggatacttatcataaggtaaaagatcagtataagaatgaaacgctatttgcgagagatcaaaaagaacatcctgaaaaatttgacgagattgcgaacgaagtttggtatgctggcgccgctcttgttaatgaagatggagaggttgaaaaaaatcttgaagtaacttacgcaggtgagggtcaaggaagaaatagaaaacttgataaagacggaaataccatttatgaaattaaaggtgcgggagatttaaggggaaaaatcattgaagtcattgcattagatggttctagcaatttcacaaagattcatagaattaaatttgctaatcaggctgatgaaaaggggatgatttcctattatctagtagatcctgatcaagattcatctaaatatcaaaagcttggcgagattgcagaatctaaatttaaaaatttaggaaatggaaaagagggtagtctaaaaaaagatacaactggggtagaacatcatcatcaagaaaatgaagagtctattaaagaaaaatctagttttactattgatagaaatatttcaacaattagagactttgaaaataaagacttaaagaaactcattaaaaagaaatttagagaagttgatgattttacaagtgaaactggtaagagaatggaggaatacgattataaatacgatgataaaggaaatataatagcctacgatgatgggactgatctagaatatgaaactgagaaacttgacgaaatcaaatcaaaaatttatggtgttctaagtccgtctaaagatggacactttgaaattcttggaaagataagtaatgtttctaaaaatgccaaggtatattatgggaataactataaatctatagaaatcaaagcgaccaagtatgatttccactcaaaaacgatgacatttgatctatacgctaatattaatgatattgtggatggattagcttttgcaggagatatgagattatttgttaaagataatgatcagaaaaaagctgaaattaaaattagaatgcctgaaaaaattaaggaaactaaatcagaatatccctatgtatcaagttatgggaatgtcatagaattaggggaaggagatctttcaaaaaacaaaccagacaatttaactaaaatggaatctggtaaaatctattctgattcagaaaaacaacaatatctgttaaaggataatatcattctaagaaaaggctatgcactaaaagtgactacctataatcctggaaaaacggatatgttagaaggaaatggagtctatagcaaggaagatatagcaaaaatacaaaaggccaatcctaatctaagagccctttcagaaacaacaatttatgctgatagtagaaatgttgaagatggaagaagtacccaatctgtattaatgtcggctttggacggctttaacattataaggtatcaagtgtttacatttaaaatgaacgataaaggggaagctatcgataaagacggaaatcttgtgacagattcttctaaacttgtattatttggtaaggatgataaagaatacactggagaggataagttcaatgtagaagctataaaagaagatggctccatgttatttattgataccaaaccagtaaacctttcaatggataagaactactttaatccatctaaatctaataaaatttatgtacgaaatccagaattttatttaagaggtaagatttctgataagggtggttttaactgggaattgagagttaatgaatcggttgtagataattatttaatctacggagatttacacattgataacactagagattttaatattaagctgaatgttaaagacggtgacatcatggactggggaatgaaagactataaagcaaacggatttccagataaggtaacagatatggatggaaatgtttatcttcaaactggctatagcgatttgaatgctaaagcagttggagtccactatcagtttttatatgataatgttaaacccgaagtaaacattgatcctaagggaaatactagtatcgaatatgctgatggaaaatctgtagtctttaacatcaatgataaaagaaataatggattcgatggtgagattcaagaacaacatatttatataaatggaaaagaatatacatcatttaatgatattaaacaaataatagacaagacactaaacattaagattgttgtaaaagattttgcaagaaatacaaccgtaaaagaattcattttaaataaagatacgggagaggtaagtgaattaaaacctcatagggtaactgtgaccattcaaaatggaaaagaaatgagttcaacgatagtgtcggaagaagattttattttacctgtttataagggtgaattagaaaaaggataccaatttgatggttgggaaatttctggtttcgaaggtaaaaaagacgctggctatgttattaatctatcaaaagatacctttataaaacctgtattcaagaaaatagaggagaaaaaggaggaagaaaataaacctacttttgatgtatcgaaaaagaaagataacccacaagtaaaccatagtcaattaaatgaaagtcacagaaaagaggatttacaaagagaagagcattcacaaaaatctgattcaactaaggatgttacagctacagttcttgataaaaacaatatcagtagtaaatcaactactaacaatcctaataagttgccaaaaactggaacagcaagcggagcccagacactattagctgccggaataatgtttatagtaggaatttttcttggattgaagaaaaaaaatcaagat

SEQ ID NO: 34 - DNA, 6699 bp, Streptococcus pneumoniae
atggggaaaggccattggaatcggaaaagagtttatagcattcgtaagtttgctgtgggagcttgctcagtaatgattgggacttgtgcagttttattaggaggaaatatagctggagaatctgtagtttatgcggatgaaacacttattactcatactgctgagaaacctaaagaggaaaaaatgatagtagaagaaaaggctgataaagctttggaaactaaaaatatagttgaaaggacagaacaaagtgaacctagttcaactgaggctattgcatctgagaagaaagaagatgaagccgtaactccaaaagaggaaaaagtgtctgctaaaccggaagaaaaagctccaaggatagaatcacaagcttcaaatcaagaaaaaccgctcaaggaagatgctaaagctgtaacaaatgaagaagtgaatcaaatgattgaagacaggaaagtggattttaatcaaaattggtactttaaactcaatgcaaattctaaggaagccattaaacctgatgcagacgtatctacgtggaaaaaattagatttaccgtatgactggagtatctttaacgatttcgatcatgaatctcctgcacaaaatgaaggtggacagctcaacggtggggaagcttggtatcgcaagactttcaaactagatgaaaaagacctcaagaaaaatgttcgccttacttttgatggcgtctacatggattctcaagtttatgtcaatggtcagttagtggggcattatccaaatggttataaccagttctcatatgatatcaccaaataccttcaaaaagatggtcgtgagaatgtgattgctgtccatgcagtcaacaaacagccaagtagccgttggtattcaggaagtggtatctatcgtgatgtgactttacaagtgacagataaggtgcatgttgagaaaaatgggacaactattttaacaccaaaacttgaagaacaacaacatggcaaggttgaaactcatgtgaccagcaaaatcgtcaatacggacgacaaagaccatgaacttgtagccgaatatcaaatcgttgaacgaggtggtcatgctgtaacaggcttagttcgtacagcgagtcgtaccttaaaagcacatgaatcaacaagcctagatgcgattttagaagttgaaagaccaaaactctggactgttttaaatgacaaacctgccttgtacgaattgattacgcgtgtttaccgtgacggtcaattggttgatgctaagaaggatttgtttggttaccgttactatcactggactccaaatgaaggtttctctttgaatggtgaacgtattaaattccatggagtatccttgcaccacgaccatggggcgcttggagcagaagaaaactataaagcagaatatcgccgtctcaaacaaatgaaggagatgggagttaactccatccgtacaacccacaaccctgctagtgagcaaaccttgcaaatcgcagcagaactaggtttactcgttcaggaagaggcctttgatacgtggtatggtggcaagaaaccttatgactatggacgtttctttgaaaaagatgccactcacccagaagctcgaaaaggtgaaaaatggtctgattttgacctacgtaccatggtcgaaagaggcaaaaacaaccctgctatcttcatgtggtcaattggtaatgaaataggtgaagctaatggtgatgcccactctttagcaactgttaaacgtttggttaaggttatcaaggatgttgataagactcgctatgttaccatgggagcagataaattccgtttcggtaatggtagcggagggcatgagaaaattgctgatgaactcgatgctgttggatttaactattctgaagataattacaaagcccttagagctaagcatccaaaatggttgatttatggatcagaaacatcttcagctacccgtacacgtggaagttactatcgccctgaacgtgaattgaaacatagcaatggacctgagcgtaattatgaacagtcagattatggaaatgatcgtgtgggttgggggaaaacagcaaccgcttcatggacttttgaccgtgacaacgctggctatgctggacagtttatctggacaggtacggactatattggtgaacctacaccatggcacaaccaaaatcaaactcctgttaagagctcttactttggtatcgtagatacagccggcattccaaaacatgacttctatctctaccaaagccaatgggtttctgttaagaagaaaccgatggtacaccttcttcctcactggaactgggaaaacaaagaattagcatccaaagtagctgactcagaaggtaagattccagttcgtgcttattcgaatgcttctagtgtagaattgttcttgaatggaaaatctcttggtcttaagactttcaataaaaaacaaaccagcgatgggcggacttaccaagaaggtgcaaatgctaatgaactttatcttgaatggaaagttgcctatcaaccaggtaccttggaagcaattgctcgtgatgaatctggcaaggaaattgctcgagataagattacgactgctggtaagccagcggcagttcgtcttattaaggaagaccatgcgattgcagcagatggaaaagacttgacttacatctactatgaaattgttgacagccaggggaatgtggttccaactgctaataatctggttcgcttccaattgcatggccaaggtcaactggtcggtgtagataacggagaacaagccagccgtgaacgctataaggcgcaagcagatggttcttggattcgtaaagcatttaatggtaaaggtgttgccattgtcaaatcaactgaacaagcagggaaattcaccctgactgcccactctgatctcttgaaatcgaaccaagtcactgtctttactggtaagaaagaaggacaagagaagactgttttggggacagaagtgccaaaagtacagaccattattggagaggcacctgaaatgcctaccactgttccgtttgtatacagtgatggtagccgtgcagaacgtcctgtaacctggtcttcagtagatgtgagcaagcctggtattgtaacggtgaaaggtatggctgacggacgagaagtagaagctcgtgtagaagtgattgctcttaaatcagagctaccagttgtgaaacgtattgctccaaatactgacttgaattctgtagacaaatctgtttcctatgttttgattgatggaagtgttgaagagtatgaagtggacaagtgggagattgccgaagaagataaagctaagttagcaattccaggttctcgtattcaagcgaccggttatttagaaggtcaaccaattcatgcaacccttgtggtagaagaaggcaatcctgcggcacctgcagtaccaactgtaacggttggtggtgaggcagtaacaggtcttactagtcaaaaaccaatgcaataccgcactcttgcttatggagctaagttgccagaagtcacagcaagtgctaaaaatgcagctgttacagttcttcaagcaagcgcagcaaacggcatgcgtgcgagcatctttattcagcctaaagatggtggccctcttcaaacctatgcaattcaattccttgaagaagcgccaaaaattgctcacttgagcttgcaagtggaaaaagctgacagtctcaaagaagaccaaactgtcaaattgtcggttcgagctcactatcaagatggaacgcaagctgtattaccagctgataaagtaaccttctctacaagtggtgaaggggaagtcgcaattcgtaaaggaatgcttgagttgcataagccaggagcagtcactctgaacgctgaatatgagggagctaaagaccaagttgaactcactatccaagccaatactgagaagaagattgcgcaatccatccgtcctgtaaatgtagtgacagatttgcatcaggaaccaagtcttccagcaacagtaacagttgagtatgacaaaggtttccctaaaactcataaagtcacttggcaagctattccgaaagaaaaactagactcctatcaaacatttgaagtactaggtaaagttgaaggaattgaccttgaagcgcgtgcaaaagtctctgtagaaggtatcgtttcagttgaagaagtcagtgtgacaactccaatcgcagaagcaccacaattaccagaaagtgttcggacatatgattcaaatggtcacgtttcatcagctaaggttgcatgggatgcgattcgtccagagcaatacgctaaggaaggtgtctttacagttaatggtcgcttagaaggtacgcaattaacaactaaacttcatgttcgcgtatctgctcaaactgagcaaggtgcaaacatttctgaccaatggaccggttcagaattgccacttgcctttgcttcagactcaaatccaagcgacccagtttcaaatgttaatgacaagctcatttcctacaataaccaaccagccaatcgttggacaaactggaatcgtactaatccagaagcttcagtcggtgttctgtttggagattcaggtatcttgagcaaacgctccgttgataatctaagtgtcggattccatgaagaccatggagttggtgtaccgaagtcttatgtgattgagtattatgttggtaagactgtcccaacagctcctaaaaaccctagttttgttggtaatgaggaccatgtctttaatgattctgccaactggaaaccagttactaatctaaaagcccctgctcaactcaaggctggagaaatgaaccactttagctttgataaagttgaaacctatgctgttcgtattcgcatggttaaagcagataacaagcgtggaacgtctatcacagaggtacaaatctttgcgaaacaagttgcggcagccaagcaaggacaaacaagaatccaagttgacggcaaagacttagcaaacttcaaccctgatttgacagactactaccttgagtctgtagatggaaaagttccggcagtcacagcaagtgttagcaacaatggtctcgctaccgtcgttccaagcgttcgtgaaggtgagccagttcgtgtcatcgcgaaagctgaaaatggcgacatcttaggagaataccgtctgcacttcactaaggataagagcttactttctcataaaccagttgctgcggttaaacaagctcgcttgctacaagtaggtcaagcacttgaattgccgactaaggttccagtttacttcacaggtaaagacggctacgaaacaaaagacctgacagttgaatgggaagaagttccagcggaaaatctgacaaaagcaggtcaatttactgttcgaggccgtgtccttggtagtaaccttgttgctgagatcactgtacgagtgacagacaaacttggtgagactctttcagataaccctaactatgatgaaaacagtaaccaggcctttgcttcagcaaccaatgatattgacaaaaactctcatgaccgcgttgactatctcaatgacggagatcattcagaaaatcgtcgttggacaaactggtcaccaacaccatcttctaatccagaagtatcagcgggtgtgattttccgtgaaaatggtaagattgtagaacggactgttacacaaggaaaagttcagttctttgcagatagtggtacggatgcaccatctaaactcgttttagaacgctatgtcggtccagagtttgaagtgccaacctactattcaaactaccaagcctacgacgcagaccatccattcaacaatccagaaaattgggaagctgttccttatcgtgcggataaagacattgcagctggtgatgaaatcaacgtaacatttaaagctatcaaagccaaagctatgagatggcgtatggagcgtaaagcagataagagcggtgttgcgatgattgagatgaccttccttgcaccaagtgaattgcctcaagaaagcactcaatcaaagattcttgtagatggaaaagaacttgctgatttcgctgaaaatcgtcaagactatcaaattacctataaaggtcaacggccaaaagtctcagttgaagaaaacaatcaagtagcttcaactgtggtagatagtggagaagatagctttccagtacttgttcgcctcgtttcagaaagtggaaaacaagtcaaggaataccgtatccacttgactaaggaaaaaccagtttctgagaagacagttgctgctgtacaagaagatcttccaaaaatcgaatttgttgaaaaagatttggcatacaagacagttgagaaaaaagattcaacactgtatctaggtgaaactcgtgtagaacaagaaggaaaagttggaaaagaacgtatctttacagcgattaatcctgatggaagtaaggaagaaaaactccgtgaagtggtagaagttccgacagaccgcatcgtcttggttggaaccaaaccagtagctcaagaagctaaaaaaccacaagtgtcagaaaaagcagatacaaaaccaattgattcaagtgaagctagtcaaactaataaagcccagttaccaagtacaggtagtgcggcaagccaagcagcagtagcagcaggtttaactcttctaggtttgagtgcaggattagtagttactaaaggtaaaaaagaagac

SEQ ID NO: 35 - DNA, 5643 bp, Streptococcus pneumoniae
atggctccttctgtagtggacgcagccacctatcactatgtaaataaagagattatttcacaagaagctaaagatttaattcagacaggaaagcctgacaggaatgaagttgtatatggtttggtgtatcaaaaagatcagttgcctcaaacagggacagaagcatctgttttgacagcttttggtttgctgactgttgggagcttgcttttaatctacaagagaaagaaaattgctagcgtctttctagttggagctatgggattggtagttcttcctagtgcaggggctgtagacccagttgcgaccctagcgctggctagtcgagagggtgttgttgaaatggagggctatcgctatgttggttatctatcaggtgacatcctcaaaacgcttggcttggacactgttttagaagaaacctcagcaaaacctggagaggtgactgtggtcgaagttgagactcctcaatcaataacaaatcaggagcaagctaggacagaaaaccaagtagtagagacagaggaagctccaaaagaagaagcacctaaaacagaagaaagtccaaaggaagaaccaaaatcggaggtaaaacctactgacgacacccttcctaaagtagaagaggggaaagaagattcagcagaaccagctccagttgaagaagtaggtggagaagttgagtcaaaaccagaggaaaaagtagcagttaagccagaaagtcaaccatcagacaaaccagctgaggaatcaaaagttgaacaagcaggtgaaccagtcgcgccaagagaagacgaaaaggcaccagtcgagccagaaaagcaaccagaagctcctgaagaagagaaggctgtagaggaaacaccgaaacaagaagagtcaactccagataccaaggctgaagaaactgtagaaccaaaagaggagactgttaatcaatctattgaacaaccaaaagttgaaacgcctgctgtagaaaaacaaacagaaccaacagaggaaccaaaagttgaacaagcaggtgaaccagtcgcgccaagagaagacgaacaggcaccaacggcaccagttgagccagaaaagcaaccagaagttcctgaagaagagaaggctgtagaggaaacaccgaaaccagaagataaaataaagggtattggtactaaagaaccagttgataaaagtgagttaaataatcaaattgataaagctagttcagtttctcctactgattattctacagcaagttacaatgctcttggacctgttttagaaactgcaaaaggtgtctatgcttcagagcctgtaaaacagcctgaggtaaatagcgagacaaataaacttaaaacggctattgacgctctaaacgttgataaaactgaattaaacaatacgattgcagatgcaaaaacaaaggtaaaagaacattacagtgatagaagttggcaaaacctccaaactgaagttacaaaggctgaaaaagttgcagctaatacagatgctaaacaaagtgaagttaacgaagctgttgaaaaattaactgcaactattgaaaaattggttgaattatctgaaaagccaatattaacattgactagtaccgataagaaaatattggaacgtgaagctgttgctaagtatactctagaaaatcaaaacaaaacaaaaatcaaatcaatcacagctgaattgaaaaaaggagaagaagttattaatactgtagtccttacagatgacaaggtaacaacagaaactataagcgctgcatttaagaacctagagtactacaaagaatacaccctatctacaactatgatttacgacagaggtaacggtgaagaaactgaaactctagaaaatcaaaatattcaattagatcttaaaaaagttgagcttaaaaatattaaacgtacagatttaatcaaatacgaaaatggaaaagaaactaatgaatcactgataacaactattcctgatgataagagcaattattatttaaaaataacttcaaataatcagaaaactacattactagctgttaaaaatatagaagaaactacggttaacggaacacctgtatataaagttacagcaatcgcagacaatttagtctctagaactgctgataataaatttgaagaagaatacgttcactatattgaaaaacctaaagtccacgaagataatgtatattataatttcaaagaattagtggaagctattcaaaacgatccttcaaaagaatatcgtctgggacaatcaatgagcgctagaaatgttgttcctaatggaaaatcatatatcactaaagaattcacaggaaaacttttaagttctgaaggaaaacaatttgctattactgaattggaacatccattatttaatgtgataacaaacgcaacgataaataatgtgaattttgaaaatgtagagatagaacgttctggtcaagataatattgcatcattagccaatactatgaaaggttcttcagttattacaaatgtcaaaattacaggcacactttcaggtcgtaataatgttgctggatttgtaaataatatgaatgatggaactcgtattgaaaatgttgctttctttggcaaactacactctacaagtggaaatggctctcatacagggggaattgcaggtacaaactatagaggaattgttagaaaagcatatgttgatgctactattacaggaaacaaaacacgcgccagcttgttagttcctaaagtagattatggattaactctagaccatcttattggtacaaaagctctcctaactgagtcggttgtaaaaggtaaaatagatgtttcaaatccagtagaagttggagcaatagcaagtaagacttggcctgtaggtacggtaagtaattctgtcagctatgctaagattatccgtggagaggagttattcggctctaacgacgttgatgattctgattatgctagtgctcatataaaagatttatatgcggtagagggatattcgtcaggtaatagatcatttaggaaatctaaaacatttactaaattaactaaagaacaagctgatgctaaagttactactttcaatattactgctgataaattagaaagtgatctatctcctcttgcaaaacttaatgaagaaaaagcctattctagtattcaagattataacgctgaatataaccaagcctataaaaatcttgaaaaattaataccattctacaataaagattatattgtatatcaaggtaataaattaaataaagaacaccatctaaatactaaagaagttctttctgttaccgcgatgaacaacaatgagtttatcacaaacctagatgaagctaataaaattattgttcactatgcggacggtacaaaagattactttaacttgtcttctagcagtgaaggtttaagtaatgtaaaagaatatactataactgacttaggaattaaatatacacctaatatcgttcaaaaagataacactactcttgttaatgatataaaatctattttagaatcagtagagcttcagtctcaaacgatgtatcagcatctaaatcgattaggtgactatagagttaatgcaatcaaagatttatatttagaagaaagcttcacagatgttaaagaaaacttaacaaacctaatcacaaaattagttcaaaacgaagaacatcaactaaatgattctccagctgctcgtcaaatgattcgtgataaagtcgagaaaaacaaagcagctttattactaggtttaacttacctaaatcgttactatggagttaaatttggtgatgttaatattaaagaattaatgctattcaaaccagatttctatggtgaaaaagttagcgtattagacagattaattgaaatcggttctaaagagaacaacattaaaggttcacgtacattcgacgcattcggtcaagtattggctaaatatactaaatcaggtaatttagatgcatttttaaattataatagacaattgttcacaaatatagacaatatgaacgattggtttattgatgctacagaagaccatgtctacatcgcagaacgcgcttctgaggtcgaagaaattaaaaattctaaacatcgtgcattcgataatttaaaacgaagtcaccttagaaatactatactcccactactgaatattgataaagcacatctttatttaatttcaaattataatgcaattgcctttggtagtgcagagcgattaggtaaaaaatcattagaagatattaaagatatcgttaacaaagctgcagatggttatagaaactattatgatttctggtatcgtctagcgtctgataacgttaaacaacgactactaagagatgctgttattcctatttgggaaggttataacgctcctggtggatgggttgaaaaatatggccgctataataccgacaaagtatatactcctcttagagaattctttggtcctatggataagtattataattataatggaacaggagcttatgctgctatatatcctaactctgatgatattagaactgatgtaaaatatgttcatttagaaatggttggtgaatacggtatttcagtttacacacatgaaacaacacacgtcaacgaccgtgcgatttacttaggtggctttggacaccgtgaaggtactgatgctgaagcatatgctcagggtatgctacaaactcctgttactggtagtggatttgatgagtttggttctttaggtattaatatggtatttaaacgcaaaaatgatgggaatcagtggtatattacagatccaaaaactctaaaaacacgagaagatattaatagatatatgaagggttataatgacactttaactcttcttgatgaaattgaggctgaatctgtgatttctcaacaaaataaagatttaaatagtgcatggttcaaaaaaatagatagagaataccgtgataacaataaattaaatcaatgggataaaattcgaaatctaagtcaagaagagaaaaatgaattaaatattcaatctgttaatgatttagttgatcaacaattaatgactaatcgcaatccaggtaatggtatctataaacccgaagcaattagctataacgatcaatcaccttatgtaggtgttagaatgatgaccggtatctacggaggtaatactagtaaaggtgctcctggagctgtttcattcaaacataatgcttttagattatggggttactacggatacgaaaatgggttcttaggttatgcttcaaataaatataaacaacaatctaaaacagatggtgagtctgttctaagtgatgaatatattatcaagaaaatatctaacaatacatttaatactattgaagaatttaaaaaagcttacttcaaagaagttaaagataaagcaacgaaaggattaacaacattcgaagtaaatggttcttccgtttcatcatacgatgatttactgacattgtttaaagaagctgttaaaaaagatgccgaaactcttaaacaagaagcaaacggtaataaaacagtatctatgaataatacagttaaattaaaagaagctgtttataagaaacttcttcaacaaacaaatagctttaaaacttcaatctttaaa

SEQ ID NO: 36 - DNA, 996 bp, Streptococcus pneumoniae
atgaataaacgtctattttcaaaaatgagtctggtgacgttgccaattttagccttgttttcacaatcagttttggcggaagaaaacatccatttttcgagctgtaaggaagcttgggcgaatggctattcggatattcacgagggagaacctggttattctgccaagttagaccgtgatcatgatggtgtggcttgcgaattgaaaaatgctcctaagggtgcttttaaagcaaaacagtcaacggctattcaaatcaacacaagttcagcaacaacaagtggttgggttaagcaggacggcgcttggtactactttgatggaaatggaaatctagtgaaaaatgcatggcagggaagctattacctgaaagctgatggtaaaatggcacagagtgaatggatttatgactcttcttatcaagcttggtattatttgaaatcagatggttcttatgcaaaaaatgcatggcaaggagcttattaccttaaatcaaacggtaaaatggcacaaggtgagtgggtttatgattcttcttaccaagcatggtattacttgaaatcagatggttcatatgctcgcaatgcatggcaaggaaactactatttgaaatcagatggtaaaatggctaaaggtgaatgggtttatgatgccacctatcaagcttggtattatttgacatcagatggttcttatgcttacagtacatggcaaggaaattactatctaaaatcggatggtaaaatggctgtcaatgaatgggttgatggtggacgttattatgttggcgctgacggagtttggaaggaagttcaagcaagtacagcttcttctagtaatgatagcaatagtgaatattctgctgctttaggaaaggcaaaaagttataattcgttattccacatgtcaaaaaaacgtatgtatagacaattaacttctgattttgataaattttcaaatgatgcagctcaatatgccattgatcatttagatgat

SEQ ID NO: 37 - DNA, 1350 bp, Streptococcus pneumoniae
atgaaagtaatagatcaatttaaaaataagaaagtccttgttttaggtttggccaagtctggtgaatctgcagctcgtttgttggacaagctaggtgccattgtgacagtaaatgatgggaaacctttcgaggacaatccagctgcccaaagtttgctggaagaagggatcaaggtcattacaggtggccatcctttggaactcttggatgaagagtttgcccttatggtgaaaaatccaggtatcccctacaacaatcccatgattgaaaaggctttggccaagggaattccagtcttgactgaggtggaattggcttatttgatttcagaagcaccgattattggtatcacaggatcgaacggtaagacaaccacaacgactatgattggggaagttttgactgctgctggccaacatggtcttttatcagggaatatcggctatccagctagtcaggttgctcaaatagcatcagataaggacacgcttgttatggaactttcttctttccaactcatgggtgttcaagaattccatccagagattgcggttattaccaacctcatgccaactcatatcgactaccatgggtcattttcggaatatgtagcagccaagtggaatatccagaacaagatgacagcagctgatttccttgtcttgaactttaatcaagacttggcaaaagacttgacttccaagacagaagccactgttgtaccattttcaacacttgaaaaggttgatggagcttatctggaagatggtcaactctacttccgtggtgaagtagtcatggcagcgaatgaaatcggtgttccaggtagccacaatgtggaaaatgcccttgcgactattgctgtagccaagcttcgtgatgtggacaatcaaaccatcaaggaaactctttcagccttcggtggtgtcaaacaccgtctccagtttgtggatgacatcaagggtgttaaattctataacgacagtaaatcaactaatatcttggctactcaaaaagccttgtcaggatttgacaacagcaaggtcgtcttgattgcaggtggtttggaccgtggcaatgagtttgacgaattggtgccagacattactggactcaagaagatggtcatcctgggtcaatctgcagaacgtgtcaaacgggcagcagacaaggctggtgtcgcttatgtggaggcgacagatattgcagatgcgacccgcaaggcctatgagcttgcgactcaaggagatgtggttcttcttagtcctgccaatgctagctgggatatgtatgctaactttgaagtacgtggcgacctctttatcgacacagtagcggagttaaaagaa

SEQ ID NO: 38 - DNA, 1158 bp, Streptococcus pneumoniae
atgaagaaaaaatttgccctatcgtttgtggcgcttgcaagtgtagcacttcttgcagcctgtggagaagtgaagtctggagcagtcaacactgctggtaactcagtagaggaaaagacaattaaaatcgggtttaactttgaagaatcaggttctttagctgcatacggaacagctgaacaaaaaggtgcccaattggctgttgatgaaatcaatgccgcaggtggtatcgatggaaaacaaatcgaagtagtcgataaagataataagtctgaaacagctgaggctgcttcagttacaactaaccttgtaacccaatctaaagtatcagcagtcgtaggacctgcgacatctggtgcgactgcagctgcggtagcgaacgctacaaaagcaggtgttccattgatctcaccaagtgcgactcaagatggattgactaaaggtcaagattacctctttattggaactttccaagatagcttccaaggaaaaattatctcaaactatgtttctgaaaaattaaatgctaagaaagttgttctttacactgacaatgccagtgactatgctaaagggattgcaaaatctttccgcgagtcatacaagggtgaaatcgttgcagatgaaactttcgtagcaggtgacacagacttccaagcagcccttacaaaaatgaaagggaaagactttgatgctatcgttgttcctggttactataatgaggctggtaaaattgtaaaccaagcgcgtggcatgggaattgacaaaccaatcgttggtggtgatggattcaacggtgaggagtttgtacaacaagcaactgctgaaaaagcatcaaacatctactttatctcaggcttctcaactactgtagaagtttcagctaaagctaaagccttccttgacgcttaccgtgctaagtacaatgaagagccttcaacatttgcagccttggcttatgattcagttcaccttgtagcaaacgcagcaaaaggtgctaaaaattcaggtgaaatcaagaataaccttgctaaaacaaaagattttgaaggtgtaactggtcaaacaagcttcgatgcagaccacaacacagtcaaaactgcttacatgatgaccatgaacaatggtaaagttgaagcagcagaagttgtaaaacca

SEQ ID NO: 39 - DNA, 1539 bp, Streptococcus pneumoniae
atgagtattttagaagttaaaaatctgagtcacggttttggtgaccgtgcaatttttgaagatgtgtccttccgtctcctcaagggagaacatatcggcctggtcggtgccaatggtgaaggaaaatcaacctttatgagtatcgtgactggtaaaatgctgccagatgaaggaaaggttgagtggtccaaatatgtgacggctggttacttggatcagcactctgtccttgctgaaagacagtcggtgcgtgatgttctccgtacggcttttgatgagcttttcaaagctgaagctcgtatcaatgacctctatatgaaaatggctgaagacggcgcggatgttgatgctctcatggaagaagtaggagaacttcaagaccgtctggagagtcgtgatttctataccttggatgctaagattgacgaagtagcgcgtgctcttggtgttatggactttggcatggatacggatgtaacttctttgtcaggtgggcaaagaaccaaggtgcttttggcaaaacttctccttgaaaagcctgatatcttgctgttggacgagccgaccaactacttggatgctgagcatattgattggctcaagcgctatctccaaaactatgagaatgcctttgttctcatttcgcacgatattccattcctcaatgacgttattaatattgtctatcatgtggaaaatcaacagctgacgcgttactctggtgactactaccagttccaagaagtttatgctatgaagaaatctcagctagaggcagcctacgaacgccagcagaaagagattgcagacctcaaggactttgtggctcgtaataaagcccgtgttgcaactcgtaatatggctatgtctcgtcaaaagaaattggataagatggatattatcgaactccaaagtgagaaaccaaaaccatcctttgatttcaaaccagctcgtacaccagggcgctttatcttccaagccaagaacttgcaaattggttacgaccgtcctcttactaagcctttaaatcttaccttcgaacgcaatcaaaaggttgcgattattggtgctaatggtattggaaaaacaactctcttgaagagtctcttgggcattatctcgccaatcgctggggaagtggagcgtggagattatttagaacttggttattttgagcaggaagtagaaggcggtaatcgccaaactcctcttgaagctgtctggaatgcctttcctgcccttaatcaagcagaagtccgtgcagcccttgcccgttgtggtttgacaaccaaacatattgaaagccagattcaagtattatcagggggagagcaagccaaggttcgtttctgtctcttgatgaatcgtgaaaacaacgttttagtgctggacgagccgaccaaccatttggatgtggatgcaaaggatgagctcaaacgcgctctcaaagaatataggggatctatccttatggtctgccacgagccagacttttatgaaggctggatagaccaaatatgggattttaataatttaact

SEQ ID NO: 40 - DNA, 1197 bp, Streptococcus pneumoniae
atgaagaaaaagaatggtaaagctaaaaagtggcaactgtatgcagcaatcggtgctgcgagtgtagttgtattgggtgctggggggattttactctttagacaaccttctcagactgctctaaaagatgagcctactcatcttgttgttgccaaggaaggaagcgtggcctcctctgttttattgtcagggacagtaacagcaaaaaatgaacaatatgtttattttgatgctagtaagggtgatttagatgaaatccttgtttctgtgggcgataaggtcagcgaagggcaggctttagtcaagtacagtagttcagaagcgcaggcggcctatgattcagctagtcgagcagtagctagggcagatcgtcatatcaatgaactcaatcaagcacgaaatgaagccgcttcagctccggctccacagttaccagcgccagtaggaggagaagatgcaacggtgcaaagcccaactccagtggctggaaattctgttgcttctattgacgctcaattgggtgatgcccgtgatgcgcgtgcagatgctgcggcgcaattaagcaaggctcaaagtcaattggatgcaacaactgttctcagtaccctagagggaactgtggtcgaagtcaatagcaatgtttctaaatctccaacaggggcgagtcaagttatggttcatattgtcagcaatgaaaatttacaagtcaagggagaattgtctgagtacaatctagccaacctttctgtaggtcaagaagtaagctttacttctaaagtgtatcctgataaaaaatggactgggaaattaagctatatttctgactatcctaaaaacaatggtgaagcagctagtccagcagccgggaataatacaggttctaaatacccttatactattgatgtgacaggcgaggttggtgatttgaaacaaggtttttctgtcaacattgaggttaaaagcaaaactaaggctattcttgttcctgttagcagtctagtaatggatgatagtaaaaattatgtctggattgtggatgaacaacaaaaggctaaaaaagttgaggtttcattgggaaatgctgacgcagaaaatcaagaaatcacttctggtttaacgaacggtgctaaggtcatcagtaatccaacatcttccttggaagaaggaaaagaggtgaaggctgatgaagcaactaat

SEQ ID NO: 41 - DNA, 690 bp, Streptococcus pneumoniae
tcagaaacaaatcacgaaattgattcaaattttgcaggtcgtttaaatatcctgcgtgcgggtgttcttgatgctaacgatggaattatttccattgctggtgtggttatcggagttgccagtgccacgaccaatatctggattatctttttatcaggttttacggctatcttagctggtgccttttcaatggctggtggagaatatgtatccgtttcaactccaaaagataccgaggaagctgccgtttcgcgagaaaaactcttgctagaccaagatagggaactagccaaaaaatccctctatgctgcttatatccaaaatggagaattcaaaacttctgcccaactcttgaccaataagatctttcttaaaaatccactcaaggctctggtagaggaaaaatatgggattgagtatgaagaatttaccaatccttggcacgctgccatttctagcttcgttgcctttttccttagaagtttgcctccaatgctgtcagtgaccatttttccaagtgattaccgcatccctgctaccgtccttattgtcggtgtggcccttcttctcactggttacacaagtgctagacttggaaaagccccaaccaaaacagctatgattcggaaccttgctattggtctcttgaccatgggagttaccttcctgctcggacaacttttcagcatt

SEQ ID NO: 42 - DNA, 1881 bp, Streptococcus pneumoniae
atgaaaaagaaattaactagtttagcacttgtaggcgcttttttaggtttgtcatggtatgggaatgttcaggctcaagaaagttcaggaaataaaatccactttatcaatgttcaagaaggtggcagtgatgcgattattcttgaaagcaatggacattttgccatggtggatacaggagaagattatgatttcccagatggaagtgattctcgctatccatggagagaaggaattgaaacgtcttataagcatgttctaacagaccgtgtctttcgtcgtttgaaggaattgggtgtccaaaaacttgattttattttggtgacccatacccacagtgatcatattggaaatgttgatgaattactgtctacctatccagttgaccgagtctatcttaagaaatatagtgatagtcgtattactaattctgaacgtctatgggataatctgtatggctatgataaggttttacagactgctgcagaaaaaggtgtttcagttattcaaaatatcacacaaggggatgctcattttcagtttggggacatggatattcagctctataattatgaaaatgaaactgattcatcgggtgaattaaagaaaatttgggatgacaattccaattccttgattagcgtggtgaaagtcaatggcaagaaaatttaccttgggggcgatttagataatgttcatggagcagaagacaagtatggtcctctcattggaaaagttgatttgatgaagtttaatcatcaccatgataccaacaaatcaaataccaaggatttcattaaaaatttgagtccgagtttgattgttcaaacttcggatagtctaccttggaaaaatggtgttgatagtgagtatgttaattggctcaaagaacgaggaattgagagaatcaacgcagccagcaaagactatgatgcaacagtttttgatattcgaaaagacggttttgtcaatatttcaacatcctacaagccgattccaagttttcaagctggttggcataagagtgcatatgggaactggtggtatcaagcgcctgattctacaggagagtatgctgtcggttggaatgaaatcgaaggtgaatggtattactttaaccaaacgggtatcttgttacagaatcaatggaaaaaatggaacaatcattggttctatttgacagactctggtgcttctgctaaaaattggaagaaaatcgctggaatctggtattattttaacaaagaaaaccagatggaaattggttggattcaagataaagagcagtggtattatttggatgttgatggttctatgaagacaggatggcttcaatatatggggcaatggtattactttgctccatcaggggaaatgaaaatgggctgggtaaaagataaagaaacctggtactatatggattctactggtgtcatgaagacaggtgagatagaagttgctggtcaacattattatctggaagattcaggagctatgaagcaaggctggcataaaaaggcaaatgattggtatttctacaagacagacggttcacgagctgtgggttggatcaaggacaaggataaatggtacttcttgaaagaaaatggtcaattacttgtgaacggtaagacaccagaaggttatactgtggattcaagtggtgcctggttagtggatgtttcgatcgagaaatctgctacaattaaaactacaagtcattcagaaataaaagaatccaaagaagtagtgaaaaaggatcttgaaaataaagaaacgagtcaacatgaaagtgttacaaatttttcaactagtcaagatttgacatcctcaacttcacaaagctctgaaacgagtgtaaacaaatcggaatcagaacag

SEQ ID NO: 43 - DNA, 1368 bp, Streptococcus pneumoniae
atggacttaggtcccacccaaagaggtattagtgtcgtgtctcaatcttatatcaatgttatcggtgctggtttggcaggttctgaagcagcttaccaaatcgcagagcgtggtattccagttaaactatatgaaatgcgtggtgtcaagtctacaccccagcataaaacagacaattttgctgagttggtttgttccaattctttgcgtggggatgctttgacaaatgcagttggtcttctcaaggaagaaatgcgtcgcttgggttctgttatcttggaatctgctgaggctacacgtgttcctgcaggtggtgcccttgcagtggaccgtgatggtttctctcaaatggtgaccgaaaaagttgccaaccaccccttgattgaagtggttcgtgatgaaattacagaattgccgacagatgttattacggttatcgctactggtcctttgacaagtgatgccttggctgaaaagattcatgctcttaatgacggtgctggtttttatttctacgatgcggcagcgcctattatcgatgtcaacactatcgatatgagcaaggtctacctcaaatcacgttatgataagggagaagcggcctacctcaatgcccctatgaccaagcaagaatttatggatttccatgaagctttggtcaatgcagaagaagcaccgcttagttcttttgaaaaagaaaagtactttgaaggatgtatgcctatcgaagtcatggccaaacgtggcattaaaactatgctttatggccctatgaagccagtcggtcttgagtacccagacgactatacaggacctcgtgatggagaatttaaaacaccttatgcggttgtgcaacttcgtcaggataatgcagctggtagcctctacaatattgttggtttccagacccacctcaaatggggagaacaaaagcgtgtcttccaaatgattccgggtcttgaaaatgcggagtttgtccgttatggtgtgatgcatcgcaattcttacatggattcaccaaatcttcttgagcagacttaccgttctaagaaacaaccaaatctcttctttgctggtcaaatgacgggtgtggaaggctatgttgagtcggcggcttcaggcttagttgcgggaattaacgcagctcgtctcttcaaggaagaaagcgaggctattttccccgagacgacagcgattggaagcttagctcattacattacccatgccgacagcaaacatttccaaccaatgaatgtcaattttgggatcatcaaggagttggaaggcgagcgtatccgtgataagaaggctcgttatgaaaaaattgcagagcgtgcccttgccgacttagaggaatttttgactgtc

SEQ ID NO: 44 - DNA, 1097 bp, Streptococcus pneumoniae
atgttaatcggaatcccaaaagaaattaaaaataacgaaaaccgtgtcgccctcacacctgcaggtgttcatagcttagttagtcgtggtcatcgtgtccttatcgaaacaaatgctggtctcggttctggctttactgatgctgactatcaaaagcaaggagctgagattgtcgctactgctggtgaagcttgggcagcagagttggttgtgaaagtaaaagaatctttaagttctgaatacggttacttgcgcgacgatcttcttctcttcacctacttgcacatggccgctgctccagaattagcagatgctatgttaacagcaaaaacaactgaaactgttcgtgacaatcaaggacaactaccgctcctcgttcctatgagtgaggttgcaggtcgtatggctgttcaaatcggagctcacttccttactaagcaagctggtggctctggtgttctacttggtggtgtaccaggtgttccaaaaggaaaagtaactatcatcggtggtggtgtcgtcggtacacatgctgcccgcatcgcccttggtcttggtgctcaagtgactattttagatattagttccaagcgtctctcagttctagaagaagtctttggaagtcaaattcaaactcttatgtctaattcattcaacattgaagcaagtgtgagagatgctgatgtggtgattggagccattctcatccctggtgcaaaagcaccggaattggtgacagatgagatggtcaaacaaatgcgtccaggctctgtatcgttgacgttgctgttgaccaaggtggcgttatcgaaacagctgaccgtgtgacaacgcacgatgaacccgtctatgaaaaacacggtgttctccactatgccgttgccaatatccctggtgcggttgctcgcacttcaaccatcgccctaaccaatgtcactcttccttatatcgaagctttggctggcaaaggattcgcacaagcaatctctgaagatgaaggcttgcgtcaaggtgtgactacttatcaaggttacttgactaacctaccagttgctcaaggacttaatcgtgactacactgatatcaatgatttagta

SEQ ID NO: 45 - DNA, 2517 bp, Streptococcus pneumoniae
atgaaaattaataaaaaatatctagcaggttcagtggcagtccttgccctaagtgtttgttcctatgaacttggtcgtcaccaagctggtcaggttaagaaagagtctaatcgagtttcttatatagatggtgatcaggctggtcaaaaggcagaaaacttgacaccagatgaagtcagtaagagggaggggatcaacgccgaacaaatcgtcatcaagattacggatcaaggttatgtgacctctcatggagaccattatcattactataatggcaaggtcccttatgatgccatcatcagtgaagagctcctcatgaaagatccgaattatcagttgaaggattcagacattgtcaatgaaatcaagggtggttatgttatcaaggtagatggaaaatactatgtttaccttaaggatgcagctcatgcggataatattcggacaaaagaagagattaaacgtcagaagcaggaacacagtcataatcacgggggtggttctaacgatcaagcagtagttgcagccagagcccaaggacgctatacaacggatgatggttatatcttcaatgcatctgatatcattgaggacacgggtgatgcttatatcgttcctcacggcgaccattaccattacattcctaagaatgagttatcagctagcgagttagctgctgcagaagcctattggaatgggaagcagggatctcgtccttcttcaagttctagttataatgcaaatccagctcaaccaagattgtcagagaaccacaatctgactgtcactccaacttatcatcaaaatcaaggggaaaacatttcaagccttttacgtgaattgtatgctaaacccttatcagaacgccatgtggaatctgatggccttattttcgacccagcgcaaatcacaagtcgaaccgccagaggtgtagctgtccctcatggtaaccattaccactttatcccttatgaacaaatgtctgaattggaaaaacgaattgctcgtattattccccttcgttatcgttcaaaccattgggtaccagattcaagaccagaacaaccaagtccacaatcgactccggaacctagtccaagtccgcaacctgcaccaaatcctcaaccagctccaagcaatccaattgatgagaaattggtcaaagaagctgttcgaaaagtaggcgatggttatgtctttgaggagaatggagtttctcgttatatcccagccaaggatctttcagcagaaacagcagcaggcattgatagcaaactggccaagcaggaaagtttatctcataagctaggagctaagaaaactgacctcccatctagtgatcgagaattttacaataaggcttatgacttactagcaagaattcaccaagatttacttgataataaaggtcgacaagttgattttgaggctttggataacctgttggaacgactcaaggatgtcccaagtgataaagtcaagttagtggatgatattcttgccttcttagctccgattcgtcatccagaacgtttaggaaaaccaaatgcgcaaattacctacactgatgatgagattcaagtagccaagttggcaggcaagtacacaacagaagacggttatatctttgatcctcgtgatataaccagtgatgagggggatgcctatgtaactccacatatgacccatagccactggattaaaaaagatagtttgtctgaagctgagagagcggcagcccaggcttatgctaaagagaaaggtttgacccctccttcgacagaccatcaggattcaggaaatactgaggcaaaaggagcagaagctatctacaaccgcgtgaaagcagctaagaaggtgccacttgatcgtatgccttacaatcttcaatatactgtagaagtcaaaaacggtagtttaatcatacctcattatgaccattaccataacatcaaatttgagtggtttgacgaaggcctttatgaggcacctaaggggtatactcttgaggatcttttggcgactgtcaagtactatgtcgaacatccaaacgaacgtccgcattcagataatggttttggtaacgctagcgaccatgttcgtaaaaataaggtagaccaagacagtaaacctgatgaagataaggaacatgatgaagtaagtgagccaactcaccctgaatctgatgaaaaagagaatcacgctggtttaaatccttcagcagataatctttataaaccaagcactgatacggaagagacagaggaagaagctgaagataccacagatgaggctgaaattcctcaagtagagaattctgttattaacgctaagatagcagatgcggaggccttgctagaaaaagtaacagatcctagtattagacaaaatgctatggagacattgactggtctaaaaagtagtcttcttctcggaacgaaagataataacactatttcagcagaagtagatagtctcttggctttgttaaaagaaagtcaaccggctcctatacag

SEQ ID NO: 46 - DNA, 3117 bp, Streptococcus pneumoniae
atgaaatttagtaaaaaatatatagcagctggatcagctgttatcgtatccttgagtctatgtgcctatgcactaaaccagcatcgttcgcaggaaaataaggacaataatcgtgtctcttatgtggatggcagccagtcaagtcagaaaagtgaaaacttgacaccagaccaggttagccagaaagaaggaattcaggctgagcaaattgtaatcaaaattacagatcagggctatgtaacgtcacacggtgaccactatcattactataatgggaaagttccttatgatgccctctttagtgaagaactcttgatgaaggatccaaactatcaacttaaagacgctgatattgtcaatgaagtcaagggtggttatatcatcaaggtcgatggaaaatattatgtctacctgaaagatgcagctcatgctgataatgttcgaactaaagatgaaatcaatcgtcaaaaacaagaacatgtcaaagataatgagaaggttaactctaatgttgctgtagcaaggtctcagggacgatatacgacaaatgatggttatgtctttaatccagctgatattatcgaagatacgggtaatgcttatatcgttcctcatggaggtcactatcactacattcccaaaagcgatttatctgctagtgaattagcagcagctaaagcacatctggctggaaaaaatatgcaaccgagtcagttaagctattcttcaacagctagtgacaataacacgcaatctgtagcaaaaggatcaactagcaagccagcaaataaatctgaaaatctccagagtcttttgaaggaactctatgattcacctagcgcccaacgttacagtgaatcagatggcctggtctttgaccctgctaagattatcagtcgtacaccaaatggagttgcgattccgcatggcgaccattaccactttattccttacagcaagctttctgccttagaagaaaagattgccagaatggtgcctatcagtggaactggttctacagtttctacaaatgcaaaacctaatgaagtagtgtctagtctaggcagtctttcaagcaatccttcttctttaacgacaagtaaggagctctcttcagcatctgatggttatatttttaatccaaaagatatcgttgaagaaacggctacagcttatattgtaagacatggtgatcatttccattacattccaaaatcaaatcaaattgggcaaccgactcttccaaacaatagtctagcaacaccttctccatctcttccaatcaatccaggaacttcacatgagaaacatgaagaagatggatacggatttgatgctaatcgtattatcgctgaagatgaatcaggttttgtcatgagtcacggagaccacaatcattatttcttcaagaaggacttgacagaagagcaaattaaggctgcgcaaaaacatttagaggaagttaaaactagtcataatggattagattctttgtcatctcatgaacaggattatccaagtaatgccaaagaaatgaaagatttagataaaaaaatcgaagaaaaaattgctggcattatgaaacaatatggtgtcaaacgtgaaagtattgtcgtgaataaagaaaaaaatgcgattatttatccgcatggagatcaccatcatgcagatccgattgatgaacataaaccggttggaattggtcattctcacagtaactatgaactgtttaaacccgaagaaggagttgctaaaaaagaagggaataaagtttatactggagaagaattaacgaatgttgttaatttgttaaaaaatagtacgtttaataatcaaaactttactctagccaatggtcaaaaacgcgtttcttttagttttccgcctgaattggagaaaaaattaggtatcaatatgctagtaaaattaataacaccagatggaaaagtattggagaaagtatctggtaaagtatttggagaaggagtagggaatattgcaaactttgaattagatcaaccttatttaccaggacaaacatttaagtatactatcgcttcaaaagattatccagaagtaagttatgatggtacatttacagttccaacctctttagcttacaaaatggccagtcaaacgattttctatcctttccatgcaggggatacttatttaagagtgaaccctcaatttgcagtgcctaaaggaactgatgctttagtcagagtgtttgatgaatttcatggaaatgcttatttagaaaataactataaagttggtgaaatcaaattaccgattccgaaattaaaccaaggaacaaccagaacggccggaaataaaattcctgtaaccttcatggcaaatgcttatttggacaatcaatcgacttatattgtggaagtacctatcttggaaaaagaaaatcaaactgataaaccaagtattctaccacaatttaaaaggaataaagcacaagaaaacttaaaacttgatgaaaaggtagaagaaccaaagactagtgagaaggtagaaaaagaaaaactttctgaaactgggaatagtactagtaattcaacgttagaagaagttcctacagtggatcctgtacaagaaaaagtagcaaaatttgctgaaagttatgggatgaagctagaaaatgtcttgtttaatatggacggaacaattgaattatatttaccatcgggagaagtcattaaaaagaatatggcagattttacaggagaagcacctcaaggaaatggtgaaaataaaccatctgaaaatggaaaagtatctactggaacagttgagaaccaaccaacagaaaataaaccagcagattctttaccagaggcaccaaacgaaaaacctgtaaaaccagaaaactcaacggataatggaatgttgaatccagaagggaatgtggggagtgaccctatgttagatccagcattagaggaagctccagcagtagatcctgtacaagaaaaattagaaaaatttacagctagttacggattaggcttagatagtgttatattcaatatggatggaacgattgaattaagattgccaagtggagaagtgataaaaaagaatttatctgatctcatagcg

SEQ ID NO: 47 - DNA, 1431 bp, Streptococcus pneumoniae
atgaaaattttatttgtagcagcagagggtgcacccttttcaaaaacaggtggtttgggagacgtcattggcgctcttccaaaatcactggtaaaagctgggcacgaagttgcagtgattttaccctactatgatatggtagaggctaaatttggaaatcagattgaagatgtgcttcattttgaggtgagcgttggttggcgcagacagtattgtggaattaagaaaacagtattaaatggtgtaaccttctactttattgacaatcaatattatttcttccgtggtcatgtttacggtgattttgatgacggagaacgctttgcctttttccaactggctgccattgaggctatggaaaggattgactttattcctgatcttctccatgttcatgactaccatacagctatgattcctttcttgttgaaggaaaaataccgttggattcaagcctatgaggacattgaaacagttttaaccattcataatttagaattccaaggacaattttcagaaggaatgttgggtgatttgtttggagttggctttgaacgttacgctgatggcacccttcgatggaacaactgtctgaactggatgaaggcaggtattctctatgcgaaccgtgtttcaaccgtttcacctagctatgctcatgaaattatgactagtcagtttggatgtaatttggatcagattcttaaaatggagtctggtaaagtatctggtatcgtgaatgggattgatgctgatctttataatcctcagacggatgctcttttagactatcatttcaatcaggaagatttgtctgggaaagccaaaaataaggcaaaattgcaagaaagagttggcttgcctgttagagcagacgttccactggtgggaattgtttctcgtttgacacgtcaaaaaggttttgatgtggtggtcgaaagtcttcaccatatcttgcaagaagatgttcagattgttcttttgggaactggcgatccagcctttgaaggagctttctcatggtttgctcagatttacccagacaagctatcaacaaatatcacttttgatgtcaaacttgctcaggaaatctacgctgcttgtgacctcttcctcatgccaagtcgttttgaaccgtgtggcttgtctcaaatgatggctatgcgttatggaaccttgccattggtccatgaagttggaggcttgcgagatacagttcgcgctttcaatccaatcgaaggaagcggtactggctttagctttgacaatctatctccttattggttaaattggactttccaaacagcattggacttgtatagaaaccatccagacatttggagaaacctacaaaaacaagctatggagagtgacttctcatgggatacagcctgcaagtcataccttgacttgtaccatagtttagttaat

SEQ ID NO: 48 - DNA, 6012 bp, Streptococcus pneumoniae
atggaaaagtattttggtgaaaaacaagagcgtttttcatttagaaaattatcagtaggacttgtatctgcaacgatttcaagtttattttttatgtctgtattagctagttcatctgtggatgctcaagaaactgcgggagttcactataaatatgtggcagattcagagctatcatcagaagaaaagaagcagcttgtctatgatattccgacatacgtggagaatgatgatgaaacttattatcttgtttataagttaaattctcaaaatcaactggcggaattgccaaatactggaagcaagaatgagaggcaagccctagttgctggtgctagcttagctgctatgggaattttaatttttgctgtttccaagaaaaaggttaagaataaaacggtattacatttagtattggttgcagggataggaaatggtgtcttagtttcagtccatgctttagaaaatcatcttttgctaaattacaatacggactatgaattgacctctggagaaaaattacctcttcctaaagagatttcaggttacacttatattggatatatcaaagagggaaaaacgacttctgagtctgaagtaagtaatcaaaagagttcagttgccactcctacaaaacaacaaaaggtggattataatgttacaccgaattttgtagaccatccatcaacagtacaagctattcaggaacaaacacctgtttcttcaactaagccgacagaagttcaagtagttgaaaaacctttctctactgaattaatcaatccaagaaaagaagagaaacaatcttcagattctcaagaacaattagccgaacataagaatctagaaacgaagaaagaggagaagatttctccaaaagaaaagactggggtaaatacattaaatccacaggatgaagttttatcaggtcaattgaacaaacctgaactcttatatcgtgaggaaactatggagacaaaaatagattttcaagaagaaattcaagaaaatcctgatttagctgaaggaactgtaagagtaaaacaagaaggtaaattaggtaagaaagttgaaatcgtcagaatattctctgtaaacaaggaagaagtttcgcgagaaattgtttcaacttcaacgactgcgcctagtccaagaatagtcgaaaaaggtactaaaaaaactcaagttataaaggaacaacctgagactggtgtagaacataaggacgtacagtctggagctattgttgaacccgcaattcagcctgagttgcccgaagctgtagtaagtgacaaaggcgaaccagaagttcaacctacattacccgaagcagttgtgaccgacaaaggtgagactgaggttcaaccagagtcgccagatactgtggtaagtgataaaggtgaaccagagcaggtagcaccgcttccagaatataagggtaatattgagcaagtaaaacctgaaactccggttgagaagaccaaagaacaaggtccagaaaaaactgaagaagttccagtaaaaccaacagaagaaacaccagtaaatccaaatgaaggtactacagaaggaacctcaattcaagaagcagaaaatccagttcaacctgcagaagaatcaacaacgaattcagagaaagtatcaccagatacatctagcaaaaatactggggaagtgtccagtaatcctagtgattcgacaacctcagttggagaatcaaataaaccagaacataatgactctaaaaatgaaaattcagaaaaaactgtagaagaagttccagtaaatccaaatgaaggcacagtagaaggtacctcaaatcaagaaacagaaaaaccagttcaacctgcagaagaaacacaaacaaactctgggaaaatagctaacgaaaatactggagaagtatccaataaacctagtgattcaaaaccaccagttgaagaatcaaatcaaccagaaaaaaacggaactgcaacaaaaccagaaaattcaggtaatacaacatcagagaatggacaaacagaaccagaaccatcaaacggaaattcaactgaggatgtttcaaccgaatcaaacacatccaattcaaatggaaacgaagaaattaaacaagaaaatgaactagaccctgataaaaaggtagaagaaccagagaaaacacttgaattaagaaatgtttccgacctagagttatacagtttgtcaaatggtacttataaacaacacatttcgttagagcaagttccaagcaatccaaatagctactttgttaaagtgaaatcttcttcattcaaagatgtatacctaccagtagcatcaatatcagaggaaagaaaaaatgataaaatcctttataaaatcacagcaaaagtagagaagcttcagcaggagatagaaagcagatataaagataattttaccttctatctagctaagaagggaacagaagaaacaacaaactttacttcctttagtaatctggtcaaagctataaaccaaaatccctctggaacctatcatttagcggccagcctgaatgctaacgaagtggagcttggtcctgatgaaagatcctatatcaaggacacctttactggtcgtttaatcggtgaaaaagatggcaagaattatgctatctataatttgaaaaaacctctgtttgaaaacttgagtggtgctacagtagaaaaactgagtctaaaaaatgttgctatttcagggaaagatgatatcggttcactggcaaatgaagctcagaataacacaaaaattaagcaagttcacgtcgatggtgttctggctggtgaacgtggtatcggtggtttgctggctaaggctgagcaatcaagcatcacagagagcagtttcaagggaagaattatcaacacttatgaaacgactgctgcctacaatatcggtggtatggtcggtcatttgacaggtgacaaggctttacttactaagtcaaaagcgacagtagccatttcatctaacacaaatacttcagatcagactgtgggtggacttgcaggcctagtagaccgagatgcacagatccaagatagctatgctgaaggtgatatcaacaatgtcaagcactttggtagagtcgctggagtggcaggcaatttgtgggatcgaacttctggtgatgttaggcatgctggaagtttgaccaatgttctcagcgatgttaatgtaaccaacggaaatgccatcactggttaccactataacgaaatgaaggtaaaggacacattcagcagcaaggccaacagagtctacaatgtcaccttggtcaaggatgaggtcgtcagcaaggaatcctttgaagaaagaggaacaatgctagatgcttctcaaattgcaagcaaaaaagcagaaatcaatcctctcattttaccaacagtggagccactttcaacaagtggcaaaaaagacagtgatttttctaaggtggcctattatcaagctaagcgcaacttgacttataaaaacattgaaaaattgctacctttctacaacaaggcaaccatcgtcaaatacggaaacctggtcaatgagaacagtcttttatatcaaaaagaactcttgtcagcagtcatgatgaaggacaaccaagtcatcacagacattgtttctaacaaacagactgcaaacaaactcttgcttcactacaaggatgatttatctgagaagctggatctcaaataccagaatgatttcgccaaattagcagaatatagtctgggcaatactggacttctctatacgccaaaccaattcctgtatgaccaaacctctatcatcaagcaagtcttacctgacttacaaaaggttgactatcattcagaagccatcagaaagacgctgggtatttctccaaacgtcaagcaaactgagctctatctagaagaccagttcgccaaaacaaaacaacaactggaagacagtttgaaaaaactcttgtcagcggatgctggactggctagtgctaaccccgtcactgaaggttatcttgtagataaaatcaaacgcaacaaggaagccttgctacttggcttgacctatctggaacggtggtataactttagctatggtcaggtgaatgtcaaagacctagttctgtaccatttggacttctttggtaaggggaatgcttcaccattagatactctgattgagttgggtaaatctggctttaacaatcttctagctaagaataatgtcgatacttatggtatcagtcttgccagtcaacatggaacgacagatttgtttagcacgctggaacattaccgaaaagtctttttaccaaatacaagcaataatgactggtttaaatcagagactaaggcttacattgtcgaagaaaaatccactatcgaagaggtgaaaacgaagcaagggttagctggcaccaagtattctatcggtgtttatgatcgtatcacgagtgccacatggaaataccgcaatatggtcttgcctctcctgaccttgccagagagatccgtatttgtcatctcgaccatgtctagtctaggatttggagcttatgatcgctaccgcagtagtgaccataaagcgggcaaggctctcaatgattttgttgaagaaaatgcgcgtgaaacagccaaacgtcagcgagatcactacgattattggtatcgtattttagacgacaatgcacgtgaaaaactttatagaaatattttgctttacgatgcttataaatttggcgatgataataccgtagggaaagctacagaagtggcagattttgataatccaaatcctgcaatgcaacatttctttggacctgttggaaataaagttgggcataatcaacacggtgcttatgctacaggtgatgcagtttattatatgggttatcgaatgttggataaggatggagctattacttatacgcatgagatgacacatgactcagatcaggacatttatcttggaggatatggtcgaagaagtggcttgggaccagagttctttgctaaaggattattacaagcaccagaccatccagatgatgcgaccattaccatcaactccatcttgaaacattcaaaatctgatagtacagaaagtcgacgattacaagtacttgatccaactacaagatttaataatgcagatgatttgaagcaatatgtccacaacatgtttgacgttgtttatatgttggaatatctcgaaggaaattcaattcttaaattggatacgaatcaaaaacaacaacttcttagaaaagttacaaatgagtaccatcctgatcctgatggaaataaggtctatgcaacaaatgttgtcagaaatctaacagtagaagaagttgaaagactacgttcattcaatgatttgattgataataatattctttcgtctagggaatatgcctcaggtaaatacgaaagaaatggctacttcactattaagttatttgcaccgatttatgctgcattaagtaatgatataggaacaccaggtgacctgatgggacgtcgtatagcctatgaactactagctgctaaaggctttaaagatggtatggtaccatatatctcaaaccaatacgaagaagaagccaaacaaaagggcaagacaatcaatctctacggtaaaacaagaggtttggttacagatgacttggttttggaaaaggtatttaataaccaatatcatacttggagtgagtttaagaaagctatgtatcaagaacgacaagatcagtttgatagattgaacaaagttacttttaatgatacaacacagccttggcaaacatttgccaagaaaactacaagcagtgtagatgaattacagaaattaatggacgttgctgttcgtaaggatgcagaacacaattactaccattggaataactacaatccagacatagatagtgaagtccacaagctcaagagagcaatctttaaagcctatcttgaccaaacaaatgattttagaagttcaatttttgagaataaaaaa

SEQ ID NO: 49 - DNA, 2457 bp, Streptococcus pneumoniae
atgaaaattaataaaaaatatctagcaggttcagtggcagtccttgccctaagtgtttgttcctatgagcttggacgttaccaagctggtcaggataagaaagagtctaatcgagttgcttatatagatggtgatcaggctggtcaaaaggcagaaaacttgacaccagatgaagtcagtaagagggaggggatcaacgccgaacaaattgttatcaagattacggatcaaggttatgtgacctctcatggagaccattatcattactataatggcaaggttccttatgatgccatcatcagtgaagagctcctcatgaaagatccgaattatcagttgaaggattcagacattgtcaatgaaatcaagggtggttatgtcattaaggtaaacggtaaatactatgtttaccttaaggatgcagctcatgcggataatattcggacaaaagaagagattaaacgtcagaagcaggaacgcagtcataatcataactcaagagcagataatgctgttgctgcagccagagcccaaggacgttatacaacggatgatgggtatatcttcaatgcatctgatatcattgaggacacgggtgatgcttatatcgttcctcacggcgaccattaccattacattcctaagaatgagttatcagctagcgagttagctgctgcagaagcctattggaatgggaagcagggatctcgtccttcttcaagttctagttataatgcaaatccagctcaaccaagattgtcagagaaccacaatctgactgtcactccaacttatcatcaaaatcaaggggaaaacatttcaagccttttacgtgaattgtatgctaaacccttatcagaacgccatgtggaatctgatggccttattttcgacccagcgcaaatcacaagtcgaaccgccagaggtgtagctgtccctcatggtaaccattaccactttatcccttatgaacaaatgtctgaattggaaaaacgaattgctcgtattattccccttcgttatcgttcaaaccattgggtaccagattcaagaccagaagaaccaagtccacaaccgactccagaacctagtccaagtccgcaaccagctccaagcaatccaattgatgagaaattggtcaaagaagctgttcgaaaagtaggcgatggttatgtctttgaggagaatggagtttctcgttatatcccagccaaggatctttcagcagaaacagcagcaggcattgatagcaaactggccaagcaggaaagtttatctcataagctaggaactaagaaaactgacctcccatctagtgatcgagaattttacaataaggcttatgacttactagcaagaattcaccaagatttacttgataataaaggtcgacaagttgattttgaggctttggataacctgttggaacgactcaaggatgtctcaagtgataaagtcaagttagtggaagatattcttgccttcttagctccgattcgtcatccagaacgtttaggaaaaccaaatgcgcaaattacctacactgatgatgagattcaagtagccaagttggcaggcaagtacacaacagaagacggttatatctttgatcctcgtgatataaccagtgatgagggggatgcctatgtaactccacatatgacccatagccactggattaaaaaagatagtttgtctgaagctgagagagcggcagcccaggcttatgctaaagagaaaggtttgacccctccttcgacagaccatcaggattcaggaaatactgaggcaaaaggagcagaagctatctacaaccgcgtgaaagcagctaagaaggtgccacttgatcgtatgccttacaatcttcaatatactgtagaagtcaaaaacggtagtttaatcatacctcattatgaccattaccataacatcaaatttgagtggtttgacgaaggcctttatgaggcacctaaggggtatactcttgaggatcttttggcgactgtcaagtactatgtcgaacatccaaacgaacgtccgcattcagataatggttttggtaacgctagcgaccatgttcaaagaaacaaaaatggtcaagctgataccaatcaaacggaaaaaccaagcgaggagaaacctcagacagaaaaacctgaggaagaaacccctcgagaagagaaaccgcaaagcgagaaaccagagtctccaaaaccaacagaggaaccagaagaatcaccagaggaatcagaagaacctcaggtcgagactgaaaaggttgaagaaaaactgagagaggctgaagatttacttggaaaaatccaggatccaattatcaagtccaatgccaaagagactctcacaggattaaaaaataatttactatttggcacccaggacaacaatactattatggcagaagctgaaaaactattggctttattaaaggagagtaag

SEQ ID NO: 50 - DNA, 2406 bp, Streptococcus pneumoniae
ttgattttaagtgtttgttcttacgagttgggactgtatcaagctagaacggttaaggaaaataatcgtgtttcctatatagatggaaaacaagcgacgcaaaaaacggagaatttgactcctgatgaggttagcaagcgtgaaggaatcaatgctgagcaaatcgtcatcaagataacagaccaaggctatgtcacttcacatggcgaccactatcattattacaatggtaaggttccttatgacgctatcatcagtgaagaattactcatgaaagatccaaactataagctaaaagatgaggatattgttaatgaggtcaagggtggatatgttatcaaggtagatggaaaatactatgtttaccttaaggatgctgcccacgcggataacgtccgtacaaaagaggaaatcaatcgacaaaaacaagagcatagtcaacatcgtgaaggtggaactccaagaaacgatggtgctgttgccttggcacgttcgcaaggacgctatactacagatgatggttatatctttaatgcttctgatatcatagaggatactggtgatgcttatatcgttcctcatggagatcattaccattacattcctaagaatgagttatcagctagcgagttggctgctgcagaagccttcctatctggtcgaggaaatctgtcaaattcaagaacctatcgccgacaaaatagcgataacacttcaagaacaaactgggtaccttctgtaagcaatccaggaactacaaatactaacacaagcaacaacagcaacactaacagtcaagcaagtcaaagtaatgacattgatagtctcttgaaacagctctacaaactgcctttgagtcaacgacatgtagaatctgatggccttgtctttgatccagcacaaatcacaagtcgaacagctagaggtgttgcagtgccacacggagatcattaccacttcatcccttactctcaaatgtctgaattggaagaacgaatcgctcgtattattccccttcgttatcgttcaaaccattgggtaccagattcaaggccagaacaaccaagtccacaaccgactccggaacctagtccaggcccgcaacctgcaccaaatcttaaaatagactcaaattcttctttggttagtcagctggtacgaaaagttggggaaggatatgtattcgaagaaaagggcatctctcgttatgtctttgcgaaagatttaccatctgaaactgttaaaaatcttgaaagcaagttatcaaaacaagagagtgtttcacacactttaactgctaaaaaagaaaatgttgctcctcgtgaccaagaattttatgataaagcatataatctgttaactgaggctcataaagccttgtttgaaaataagggtcgtaattctgatttccaagccttagacaaattattagaacgcttgaatgatgaatcgactaataaagaaaaattggtagatgatttattggcattcctagcaccaattacccatccagagcgacttggcaaaccaaattctcaaattgagtatactgaagacgaagttcgtattgctcaattagctgataagtatacaacgtcagatggttacatttttgatgaacatgatataatcagtgatgaaggagatgcatatgtaacgcctcatatgggccatagtcactggattggaaaagatagcctttctgataaggaaaaagttgcagctcaagcctatactaaagaaaaaggtatcctacctccatctccagacgcagatgttaaagcaaatccaactggagatagtgcagcagctatttacaatcgtgtgaaaggggaaaaacgaattccactcgttcgacttccatatatggttgagcatacagttgaggttaaaaacggtaatttgattattcctcataaggatcattaccataatattaaatttgcttggtttgatgatcacacatacaaagctccaaatggctataccttggaagatttgtttgcgacgattaagtactacgtagaacaccctgacgaacgtccacattctaatgatggatggggcaatgccagtgagcatgtgttaggcaagaaagaccacagtgaagatccaaataagaacttcaaagcggatgaagagccagtagaggaaacacctgctgagccagaagtccctcaagtagagactgaaaaagtagaagcccaactcaaagaagcagaagttttgcttgcgaaagtaacggattctagtctgaaagccaatgcaacagaaactctagctggtttacgaaataatttgactcttcaaattatggataacaatagtatcatggcagaagcagaaaaattacttgcgttgttaaaaggaagtaatccttcatctgtaagtaaggaaaaaataaac

SEQ ID NO: 51 - DNA, 3252 bp, Streptococcus pneumoniae
atgccagtagaaattaaaaccactaaagaaattcatcctaaaatctatgcctacaccacaccgacagtaaccagtaatgaaggctggattaagattgggtatacagaacgtgatgtcacacaacgtatcaaggagcaaacgcatacagctcatatagctacagatgtcttatggactggtgatgcagcttatacagaagagcctgataaggggaaaactttcaaggaccatgatttccaccatttcctttctttccatgatgtagaacgtcgtcccaagacggaatggttctattttaatggaactcctgaaaaatcaaaaaatctttttgataagtttgttcagcatgatttgtctggttatcagcctggaaaaggacaggactatactctgcgacaagagcaagaagaagcagttgctaagacattagcttatttccaagaacatgctggaggcaagtttctctggaatgccaagccacgctttggtaaaaccttgtctacctatgacctagctcgacggatggaagctgtcaatgtcctaattgtaacaaaccgccctgccattgctaactcatggtatgatgattttgaaacattcatagcaggtcaaacgacttacaagtttgtttctgaatcagatagccttaagagtcgtccaatcttgtcacgacaagaatttcttggtattttagctgacgatgtaagacaacttgcttttatcagtctccaagacttgaaaggatctgtttatttaggtggagagcacgataaactcaaatgggtaactgatctgcattgggacttgttggttattgacgaggctcatgaaggagttgataccttcaagactgaccaagcctttaataagattcgacgaaattttactctgcatttgtcaggtacatcatttaaagcattggctaaaggagattttacagaggaacaaatctacaactggtcttatgctgatgagcaggctgctaagtattcgtggtctcttgagcaagaagaggaaaatccttatgaaagcttgcctcagttgaatctctttacctatcaaatgtctcagatgattggcgaaaagttagaaaaaggcgctcagatcgatggtgaaaatattgactatgtttttgacttaagtgaatttttcgctacagatgataaagggaaatttattcatgagcatgatgtcagaaattggttagatactctatcaagcaatgaaaaatatccattttcaaccaaagaactccgtaatgaactcaagcatactttttggcttttagaacgtgtcgcttcggccaaagcattaaaagccctactagaagaacacccaatctatgaaaactatgagatcgttctagctgctggtgacggacgtatgtccgaagaagacgataaagtcaaactcaaatccttggacttggttagaaaagcgatagcagagaatgacaaaaccattaccctatccgttggtcagctgacgacaggtgtcactatccctgaatggacaggtgtattgatgttatcaaatttgaaatcaccagctctttatatgcaggccgccttccgtgctcaaaatccttactcatggagcgataacaaaggaaatcactttcgcaaagaaagagcctatgtatttgactttgcgccggaaagaaccttgattctctttgatgagtttgccaacaacttattgcttgtaactgcagctggtagaggaacttcagctacacgcgaagaaaatattagagaattattaaacttctttccaattattgccgaagaccgtgctggtaagatggttgaaattgatgcaaaggcagttctaaccactcctcgccagataaaagctagagaagttcttaaacgaggttttatgtccaatctcttatttgataatattagtggtattttccaagcaagtcaaacagttttagatattttaaatgagctgccagttgaaaaggaagggaaggtacaagatagttctgatttattagatttttcagatgttacagtcgatgatgagggaaatgcagtagtagaccatgaaattgtagttaatcagcaaatgcgactttttggtgaaaaagtttatggacttggtgaatctgttgctgagttagtcacaaaagatgaggaacgaactcaaaaacagctggtcaatgacttgagtaagaccgtttcttcagtgattgtagaggaattgaaagcagattattctctaaaaacaagggaaactgagcaaattaagaaacaaattacagcaacacttgagaatgaaattcgaaaaaatgatatcgaaagaaaaatttctgaagctcatatcaagcaagagttgcaacagcagctcaaagaagcaaatgataaagcgcaaaaagataagattcaagaagatttggaaaaacgtttagaagaaaataaactcattcataaagaaaaactagaacaaacactcaaaaaagaagtggaaaaaatgcctgagaaatttatcgaacaggttgagataaaacgtgtggaacagttgaaacaatcagctcaagatgaaattcgtgaccatttacgagggtttgcaagaacaattccaagttttattatggcttacggtgatcaaactctaacacttgataattttgatgcctttgttcctgaacatgttttttatgaagtaacagggattacgattgatcagtttagatatttgcgagatggtgggcaggattttgcagggcatctctttgataaagcaacatttgacgaagctattcaagaatttcttcgcaagaaaaaggagttggcggattattttaaagatcaaaaagaagacatttttgactatattccaccgcagaagaccaaccaaattttcactcctaaacgagtggtgaaaaggatggtagatgatttggaaaaggaaaatccagggatttttgatgatccatctaagacttttattgatttatatatgaagtcaggcctctatattgcagaacttgtgaagcggttatataatagcaatggcttgaaagaggcctttccaaatcctgaagaacgcttaaaacatattttggaaaagcaagtttatggatttgctccgtctgagattatctataacatttccactaattttatatttggcaatctttctaaagatatcagtaggaagaattttgttttagcagataccattccagcggctaaagaagggagcattcaaaagttggttgattcctattttgaaaataat

SEQ ID NO: 52 - DNA, 702 bp, Streptococcus pneumoniae
atgaaaaaaatactaattgtagatgatgagaaaccaatctcggatattatcaagtttaatatgaccaaggaaggttacgaagttgtaactgcttttaatggtcgtgaagcgctagagcaatttgaagcagagcaaccagatattattattctggatttgatgcttccagaaattgatggtttagaagttgctaagaccattcgtaagacaagcagtgtgcccattcttatgctttcagccaaagatagtgaatttgataaggttatcggtttggaacttggggcagatgactatgtaacaaaacccttctccaatcgtgagttgcaggcgcgtgttaaagctcttctgcgtcgttctcaacctatgccagtagatggtcaggaagcagatagtaaacctcaacctatccaaattggggatttagaaattgttccagacgcctacgtggctaaaaaatatggcgaagaactagacttaacccatcgtgaatttgagcttttgtatcatttagcatcgcatacaggtcaagtcatcacgcgcgaacacttgcttgagactgtctggggttatgactattttggtgatgtccgtacagttgatgtgactgtacgacgtctgcgtgagaagattgaagatacgcccagccgaccagagtatatcttgacgcgccgtggtgtagggtattacatgagaaataatgct

SEQ ID NO: 53 - DNA, 2163 bp, Streptococcus pneumoniae
atgaagaaaaaatttctagcatttttgctaattttattcccaattttctcattaggtattgccaaagcagaaacgattaagattgtttctgataccgcctatgcaccttttgagtttaaagattcagatcaaacttataaaggaattgatgttgacattattaacaaagtcgctgagattaaaggctggaacattcagatgtcctatcctggatttgacgcagcagtcaatgcggttcaagctgggcaagccgacgctatcatggcagggatgacaaagactaaagaacgtgaaaaagtcttcaccatgtctgatacttactatgatacaaaagttgtcattgctactacaaagtcacacaaaattagcaagtacgaccaattaactggcaaaaccgttggtgttaaaaacggaactgccgctcaacgtttccttgaaacaatcaaagataaatacggctttactattaaaacatttgacactggtgatttaatgaacaacagcttgagtgctggtgccatcgatgccatgatggatgacaaacctgttatcgaatatgccattaaccaaggtcaagacctccatattgaaatggatggtgaagctgtaggaagttttgctttcggtgtgaaaaaaggaagtaaatacgagcacctggttactgaatttaaccaagccttgtctgaaatgaaaaaagatggtagtcttgataaaattatcaagaaatggactgcttcatcatcttcagcagtgccaactacaactactctcgcaggattaaaagctattcctgttaaggctaaatatatcattgccagcgattcttcttttgccccttttgttttccaaaattcaagcaaccaatacactggtattgatatggaattgattaaggcaatcgctaaagaccaaggttttgaaattgaaatcaccaaccctggttttgatgctgctatcagtgctgtccaagctggtcaagccgatggtatcatcgctggtatgtctgtcacagatgctcgtaaggcaacttttgacttctcagaatcatactacactgctaataccattcttggtgtcaaagaatcaagcaatattgcttcttatgaagatctaaaaggaaagacagtcggtgttaaaaacggaactgcttctcaaaccttcctaacagaaaatcaaagcaaatacggctacaaaatcaaaacctttgctgatggttcttcaatgtatgacagtttaaacactggtgccattgatgccgttatggatgatgaacctgttctcaaatattctatcagccaaggtcaaaaattgaaaactccaatctctggaactccaatcggtgaaacagcctttgccgttaaaaaaggagcaaatccagaactgattgaaatgttcaacaacggacttgcaaaccttaaagcaaacggtgaattccaaaagattcttgacaaatacctagctagcgaatcttcaactgcttcaacaagtactgttgacgaaacaacgctctggggcttgcttcaaaacaactacaaacaactccttagcggtcttggtatcactcttgctctagctcttatctcatttgctattgccattgtcatcggaattatcttcggtatgtttagcgttagcccatacaaatctcttcgcgtcatctctgagattttcgttgacgttattcgtggtattccattgatgattcttgcagccttcatcttctggggaattccaaacttcatcgagtctatcacaggccaacaaagcccaattaacgactttgtagctggaaccattgccctctcactcaatgcggctgcttatatcgctgaaatcgttcgtggtggtattcaggccgttccagttggccaaatggaagccagccgaagcttgggtatctcttatggaaaaaccatgcgtaagattatcttgccacaagcaactaaattgatgttgccaaactttgtcaaccaattcgttatcgctcttaaagatacaactatcgtatctgctatcggtttggttgaactcttccaaactggtaagattatcattgctcgtaactaccaaagtttcaagatgtatgcaatccttgctatcttctatcttgtaattatcacacttttgactagactagcgaaacgcttagaaaagaggattcgt

SEQ ID NO: 54 - DNA, 1569 bp, Streptococcus pneumoniae
atggcatttgaaagtttaacagaacgtttgcagaacgtctttaaaaatctacgtaaaaaaggaaaaatctctgaatctgatgtccaagaggcaaccaaagaaattcgcttggccttgctcgaggccgacgttgccttgcctgttgtaaaggactttatcaagaaagttcgtgagcgtgcagtcgggcatgaggtcattgatacacttaatcctgcgcaacagattattaaaatcgttgatgaggaattgacagccgttttaggttctgatacggcagaaattatcaagtcacctaagattccaaccatcatcatgatggttggtttacaaggggctggtaaaacaacctttgctggtaaattggccaacaaactcaagaaagaagaaaatgctcgtcctttgatgattgcggcggatatttatcgtccagctgccattgaccagcttaagaccttgggacaacagattgatgtgcctgtctttgcacttggaacagaagtaccagctgttgagattgtacgtcaaggtttggagcaagcccaaactaatcataacgactatgtcttgattgatactgcgggtcgtttgcagattgatgagctcctcatgaatgagcttcgtgatgtgaaagcattggctcaaccaaatgaaatcttgcttgtcgttgatgctatgattggtcaggaagcagccaatgttgcgcgtgagtttaatgctcagttggaagtgactggggtcatccttaccaagattgatggcgatactcgtggtggtgctgctctgtctgttcgtcacattactggaaaaccaatcaagttcactggtacaggtgaaaagattacggacattgaaaccttccacccagaccgcatgtctagccgtatccttggtatgggggatatgctcactttgattgagaaagcttctcaggaatacgatgaacaaaaagcccttgaaatggctgagaagatgcgcgaaaacacctttgattttaatgatttcatcgatcaattagatcaggtgcaaaatatggggccgatggaagacttgctcaagatgattccaggtatggccaacaatccagcccttcaaaacatgaaggtggatgaacgccagattgctcgtaaacgtgccattgtgtcttcgatgacacctgaagagcgtgaaaacccagatttgttaaatccaagccgtcgccgtcgtattgctgctggttctggaaatacattcgtcgaagtcaataaattcatcaaggactttaaccaggctaaacagctcatgcagggtgttatgtctggggatatgaataaaatgatgaagcaaatggggattaatccaaataaccttcctaaaaatatgccaaatatgggaggaatggatatgtctgcccttgaaggaatgatgggacaaggcggtatgcctgacttatcagctctcggaggagcaggaatgccagatatgagccagatgtttggtggcggtttgaaaggtaaaattggtgaatttgccatgaaacagtccatgaaacgtatggctaacaaaatgaagaaagcgaagaagaaacgcaag

SEQ ID NO: 55 - DNA, 699 bp, Streptococcus pneumoniae
atgagccaaatttggactaaagaaaaatttataagccaagttcaaggtggagtcattgtttcttgtcaagctttacctggtgaagccctttataatgaagaatttagcttgatgccttttatggctaaagcagctttagaggcaggagcagtgggcattcgcgcaaattctgtgcgtgatattaaagcaattcagaaagtagtagatttaccaataattggaattatcaaaagggattatccacctcaagaaccatatattactgctacgatgaaagaagtagatgaacttgtagaatgcggaacaacagtcattgcatttgatgcaactttaagaccaagatatgatggcttagttgtcagtgaatttatcaaaaaaataaaagaaaaatatccgaatcaattgctgatggcggatgtaagtaatttagatgaaggtctctatgcatttaaatcaggcgttgattttgttggtacaacattatcaggttacacaagtacaagtgtacaatcagatgagcctgattttgaactaatgaaaaaattggctgattttaatattccggtaattgccgaaggaaaaattcattatccagaacaattaaaaaaagcttatagtttaggtgttaccagtgtagtcattggtggagcgattacacgtccaaaagaaattgctcagcgatttattaatgtcatcaaa

SEQ ID NO: 56 - DNA, 1164 bp, Streptococcus pneumoniae
atgagatatttaactgcaggagaatcacacggcccccgtctaacagctattattgagggaattccagctggacttccattgacagctgaggatatcaatgaggaccttagacgccgtcagggtggctacggtcgtggtggtcgtatgaagattgagaatgaccaggttgtctttacttcgggcgttcgccacgggaagacgacaggggcgcctattactatggatgtcatcaataaggaccaccagaaatggctggacatcatgtctgcggaggacattgaagaccgccttaaaagcaagcggaaaattactcatcctcgcccaggtcatgccgatttggttggggggattaagtaccgttttgatgatttgcgaaattctttggagcgttcatcagctcgtgaaaccaccatgcgggtggcagttggtgcagtagccaaacgcctcttggctgagctggatatggagattgccaaccatgtcgtggtctttggtggcaaggaaatcgatgttcctgaaaatctgacagtcgctgaaattaagcaaagagctgcccagtctgaagtttctattgtcaaccaagaacgagaacaggaaatcaaggactatattgaccaaatcaaacgtgatggtgataccatcggtggggttgtggagacagtcgtcggaggcgttccagttggtcttggttcctatgtccaatgggatagaaaattggatgcaagattggctcaagctgttgtctctatcaatgcctttaaaggggtggaatttggtcttggctttgaggctggttatcgtaaaggcagccaagttatggatgaaattctctggtctaaagaagacggttatactcgccgtaccaataatctaggtggttttgaaggtggtatgactaatgggcaacccatcgttgttcgtggggtcatgaaacccattcctactctttataaacctcttatgagtgtggatatcgaaacccacgaaccttacaaggcaaccgtggagagaagtgatccgactgctcttccagctgcaggaatggtcatggaagcagttgtagcaacggttctggcgcaagaaatcctcgaaaaattctcatcagataatcttgaggaactaaaagaagcggtagccaaacaccgagactatacaaagaactat

SEQ ID NO: 57 - DNA, 1170 bp, Streptococcus pneumoniae
atggtagttatgaatagaataagagtcagcaaaagggttgaaaagaagcttgctaaggggctagttttactagaagccagtgatcttgagaatgtcaatcttaaggatcaggaagtagaggtgcagggtcaggaaggaaactttcttgggactgcctacctttctcagcaaaacaagggcttgggctggtttatcagcaaagacaaggtggccttcaatcaagctttctttgaaacgttgtttagaaaagccaaagaaaagagaaacgcctactatcaagatgatttgacaactgcctttcgtctctttaatcaagagggagatggctttgggggtctgacagtggacctttatggcgactacgccgtcttttcttggtataactcttatgtttatcagattcgtcagactatatcagaagcctttagacaggttttccctgaggttttaggagcttatgagaaaatccgctttaagggtttggactatgaatctgcccatgtttatggtcaagaagcacctgactttttcaatgttttagaaaatggtgtcctgtatcaagtctttatgaatgatggcttgatgacaggaattttcctagaccagcatgaggttcgcggtagtttagttgacggcttggctatgggtaaatccttactcaatatgttttcctacacagcggctttttcagtagctgcggccatgggaggagctagccatacaacttctgttgatctagccaaacgttcacgagaattgtctcaagcgcattttcaggcaaatgggctcagcacagacgagcatcgttttatagtcatggatgtctttgagtatttcaaatatgccaaacgcaaagacttgacctacgatgtgattgtcctagatccgcctagctttgctcggaataaaaaacaaactttctctgtggccaaggattatcacaagttgatttcccagagtcttgagattttaaatccgggagggattatcattgccagtaccaatgctgccaatgtttcccgtcagaaatttacagaacaaattgataaaggttttgcaggaagaagttaccagattttaaacaaatatggtcttccagcagattttgcctataataaaaaagatgaaagtagtaattacctcaaggtgattagtatgaaggttagtaaa

SEQ ID NO: 58 - DNA, 1284 bp, Streptococcus pneumoniae
atgacaaaaacattaaaacgtcctgaggttttatcacctgcagggactttagagaagctaaaggtagctgttcagtatggagcagatgctgtctttatcggtggtcaggcctatggtcttcgtagccgtgcgggaaactttactttcgaacagatggaagaaggcgtgcagtttgcggccaagtatggtgccaaggtctatgtagcggctaatatggttatgcacgaaggaaatgaagctggtgctggtgagtggttccgtaaactgcgtgatatcgggattgcagcagttatcgtatctgacccagccttgattatgattgcagtgactgaagcaccaggccttgaaatccacctttctacccaagccagtgccactaactatgaaacccttgagttctggaaagagctaggcttgactcgtgtcgttttagcgcgtgaggtttcaatggaagaattagctgagatccgcaaacgtacagatgttgaaattgaagcctttgtccatggagctatgtgtatttcatactctggacgttgtactctttcaaaccacatgagtatgcgtgatgccaaccgtggtggatgttctcagtcatgccgttggaaatacgacctttacgatatgccatttgggaaagaacgtaagagtttgcagggtgagattccagaagaattttcaatgtcagccgttgacatgtctatgattgaccacattccagatatgattgaaaatggtgtggacagtctaaaaatcgaaggacgtatgaagtctattcactacgtatcaacagtaaccaactgctacaaggcggctgtggatgcctatcttgaaagtcctgaaaagtttgaagctatcaaacaagacttggtggacgagatgtggaaggttgcccaacgtgaactggctacaggattttactatggtacaccatctgaaaatgagcagttgtttggtgctcgccgtaaaattcctgagtacaagtttgtcgctgaagtggtttcttatgatgatgcggcacaaacagcaacaattcgtcaacgaaatgtcattaacgaaggggaccaagttgagttttatggtccaggtttccgtcattttgaaacctatattgaagatttgcatgatgccaaaggcaataaaatcgaccgcgctccaaatccaatggaactattgactattaaggtgcctcaacccgttcaatcaggagatatggttcgtgcattaaaagaaggactcatcaatctttataaggaagatggaaccagcgtcacagttcgagct

SEQ ID NO: 59 - DNA, 840 bp, Streptococcus pneumoniae
atgaatacctatcaattaaataatggagtagaaattccagtattgggatttggaacttttaaggctaaggatggagaagaagcctatcgtgcagtgttagaagccttgaaggctggttatcgtcatattgatacggcggcgatttatcagaatgaagaaagtgttggtcaagcaatcaaagatagcggagttccacgtgaagaaatgttcgtaactaccaagctttggaatagtcagcaaacctatgagcaaactcgtcaagctttggaaaaatctatagaaaaactgggcttggattatttggatttgtatttgattcattggccgaacccaaaaccgctcagagaaaatgacgcatggaaaactcgcaatgcggaagtttggagagcgatggaagacctctatcaagaagggaaaatccgtgctatcggcgttagcaattttcttccccatcatttggatgccttgcttgaaactgcaactatcgttcctgcggtcaatcaagttcgcttggcgccaggtgtgtatcaagatcaagtcgtagcttactgtcgtgaaaagggaattttattggaagcttgggggccttttggacaaggagaactgtttgatagcaagcaagtccaagaaatagcagcaaatcacggaaaatcggttgctcagatagccttggcctggagcttggcagaaggatttttaccacttccaaaatctgtcacaacctctcgtattcaagctaatcttgattgctttggaattgaactgagtcatgaggagagagaaaccttaaaaacgattgctgttcaatcgggtgctccacgagttgatgatgtggatttc

SEQ ID NO: 60 - DNA, 1653 bp, Streptococcus pneumoniae
ttgagtgaaaagtcaagagaagaagagaaattaagctttaaagagcagattctgagagatttagaaaaagtaaaaggctatgatgaagttctgaaagaagatgaggcagtagttcgcactcctgcaaatgaaccttcaactgaagaactcatggctgattccttgtcaacggtagaggagattatgagaaaagctcctaccgtgcctactcacccaagtcaaggtgtaccagcttctccagcagatgagattcaaagagaaactcctggtgttccaagtcatccaagtcaagatgtaccttcttctccagcggaagaaagtggatcaagaccaggtccaggtcctgttagacctaagaaacttgaaagagaatacaatgaaaccccaacaagggtagctgtttcctatacgacggcagagaaaaaagcagaacaagcaggtccagaaacacctacgcctgctacagaaacagtggatatcatcagagatacatcacgtcgtagccgtagagaaggagcaaaacccgttaagcctaagaaagagaagaagtcacatgtgaaagcttttgtgatttcattccttgtattccttgccttgctctcagcaggtggttactttggttaccagtacgtgctagattccttattacctatcgatgctaattctaagaaatatgtgacggttggaattccagaaggttcaaacgttcaagaaatcggtacgacgcttgaaaaagctggtttggtaaagcatggtctgatttttagtttttatgccaagtataaaaattataccgacttgaaagcaggttactacaatttgcaaaagagtatgagtacagaagacttactcaaagagttgcaaaaaggtggaacagatgaaccgcaagaacctgtacttgcgactttgacaattccagaaggttataccttggatcagattgctcaagctgtgggtcaattgcaaggtgacttcaaagagtctttgacagcggaggctttcttggctaaagttcaagatgagacgtttatcagtcaagcagtagcgaaatatcctactttactggaaagtttgcctgtaaaagacagcggtgcgcgttatcgtttggaaggataccttttcccagctacatactctatcaaggaaagcacaactattgagagcttgattgatgagatgttagctgctatggataagaacctatctccttactatagtactatcaaatctaaaaacttgactgtcaatgagttgttgaccattgcttccttggtcgaaaaagaaggtgccaagacagaagatcgtaagctcattgcaggtgtattctacaatcgtttgaatcgtgatatgccacttcaaagtaatattgcaatcttgtatgcccaaggaaaactggggcaaaatatcagtctagctgaggatgttgcgattgataccaacattgattcaccttataatgtttataaaaatgtaggtctcatgcctggtccagtcgatagtccaagtctggatgcgattgagtcaagcatcaatcaaactaagagcgataacctctactttgtagcagatgtcacagaaggcaaggtctactatgctaacaatcaagaagaccacgaccgcaatgtcgctgaacatgtcaacagcaaattaaac

SEQ ID NO: 61 - DNA, 615 bp, Streptococcus pneumoniae
atgaaacaagaacgatttccattggtgtcagatgacgaggtcatgttgactgaaatgccagtcatgaatctctatgatgagtctgatctgatcagtaatatcaagggtgagtatcgagataaaaattatttagaatgggctcctattgctgaagaaaaaccagtaaaaccgattgaaaagcaagtcgaaaaacctaaaaaggctcctttaggggttaaaaaagaaggaaagagctatgcggaggtggcgcgtgaagaagcgcgtgcggacttgaaaaagaaacgctctgctaactacctaactcaggatttcagccttgcgagacgtcattctcagcccagtctagttagacagggcaatcaaccgacagctcctttccaaaaggaaaatcctggtgaatttgtcaaatatagccaaaaattgacccagtctcattatatcttggcggaagaagttcattctatccctaccaagaatgaagaagtgtcagcacctgctccaaagaaaaacaattatgattttctaaagaagagccaaatctacaataaaaaaagtaaacaaacagaacaagaacgtcgggttgcccaagagttgaatctgaccagaatgacagaa

SEQ ID NO: 62 - DNA, 1956 bp, Streptococcus pneumoniae
atgaaaaagtctaagagcaaatatctaaccttggcaggtcttgtcctgggtacaggagttttattgagcgcgtgtggaaattctagcacggcgtcaaaaacctacaactatgtttattcaagtgatccatctagcttgaactatctagcagaaaaccgcgcagcaacatccgatattgttgcaaatttggtagacgggttattagaaaatgaccaatatgggaatattattccatcattagcagaggattggactgtttctcaggacggtttgacctatacctacaaacttcgtaaggatgccaagtggtttacttctgagggagaagaatatgcgcctgtaactgcccaggattttgtgacaggtttgcaatatgcagctgataaaaaatcagaagccttgtatctagtgcaggactctgttgctggtttggatgactatatcactggtaaaacaagcgacttttcaactgtcggtgtcaaggcacttgatgaccaaacggttcaatatactttggttaaaccagaactttactggaattcaaaaacacttgcaacgatactttttcctgttaatgcagatttcctgaaatcaaaaggggatgattttgggaaggcggatccatctagtattttgtacaatggacctttcttgatgaaagcacttgtctcaaaatctgctattgaatataagaaaaaccctaattactgggatgctaagaatgtctttgtagacgatgtgaaattgacctactatgatggtagcgaccaagaatcactggaacgtaattttacagctggtgcttatactacggctcgtctttttcctaacagctccagctatgaagggattaaagaaaaatacaaaaacaatatcatctatagtatgcaaaattcaacttcatatttctttaattttaacctagataggaagtcttacaattatacttctaaaacaagtgacattgaaaagaaatcgactcaggaagcagttctcaataaaaacttccgtcaggctatcaattttgcttttgacagaacatcttatggggctcagtctgaagggaaagaaggtgcaacaaagattttgcgtaacctagtggttcctccaaactttgtcagtatcaagggaaaagactttggtgaagttgtagcctctaagatggtcaactatggtaaggaatggcaaggtatcaactttgcggatggtcaagacccttactacaatcctgagaaagccaaggctaagtttgcggaagctaagaaagaactcgaagcaaagggtgttcaattcccaatccacttggataagactgtggaagtaacagataaagtaggcatacaaggagttagttctatcaaacaatcaattgaatctgttttaggttctgataatgtagtgattgacattcagcaattaacatcagatgagtttgacagttcaggctactttgctcaaacagctgctcagaaagattatgatttatatcatggcggttggggacctgattatcaagacccgtcaacctatctcgatatttttaatactaatagtggaggatttctgcaaaatcttggactagagcctggtgaggccaatgacaaggctaaggcagttggactggatgtctatactcaaatgttggaagaagctaataaagagcaagatccggccaaacgttatgagaaatatgctgatattcaagcttggttgattgatagttctttagttcttccaagtgtttcgcgtgggggaacaccatcattgagaagaaccgtaccatttgctgctgcctatggtttaaccggtacaaaaggggttgaatcatataaatacctcaaagtacaagataagattgtcacaacagacgaatatgcaaaagccagagaaaaatggttgaaagaaaaagaagaatccaataaaaaagcccaagaagaattggcaaaacatgtcaaa

SEQ ID NO: 63 - DNA, 1518 bp, Streptococcus pneumoniae
gtggaacagcattcagatgtctgttacattttttataggagagaaagattgaaaacaaaaattggattagcaagtatctgtttactaggcttggcaactagtcatgtcgctgcaaatgaaactgaagtagcaaaaacttcgcaggatacaacgacagcttcaagtagttcagagcaaaatcagtcttctaataaaacgcaaacgagcgcagaagtacagactaatgctgctgcccactgggatggggattattatgtaaaggatgatggttctaaagctcaaagtgaatggatttttgacaactactataaggcttggttttatattaattcagatggtcgttactcgcagaatgaatggcatggaaattactacctgaaatcaggtggatatatggcccaaaacgagtggatctatgacagtaattacaagagttggttttatctcaagtcagatggggcttatgctcatcaagaatggcaattgattggaaataagtggtactacttcaagaagtggggttacatggctaaaagccaatggcaaggaagttatttcttgaatggtcaaggagctatgatgcaaaatgaatggctctatgatccagcctattctgcttatttttatctaaaatccgatggaacttatgctaaccaagagtggcaaaaagtgggcggcaaatggtactatttcaagaagtggggctatatggctcggaatgagtggcaaggcaactactatttgactggaagtggtgccatggcgactgacgaagtgattatggatggtactcgctatatctttgcggcctctggtgagctcaaagaaaaaaaagatttgaatgtcggctgggttcacagagatggtaagcgctatttctttaataatagagaagaacaagtgggaaccgaacatgctaagaaagtcattgatattagtgagcacaatggtcgtatcaatgattggaaaaaggttattgatgagaacgaagtggatggtgtcattgttcgtctaggttatagcggtaaagaagacaaggaattggcgcataacattaaggagttaaaccgtctgggaattccttatggtgtctatctctatacctatgctgaaaatgagaccgatgctgagagtgacgctaaacagaccattgaacttataaagaaatacaatatgaacctgtcttaccctatctattatgatgttgagaattgggaatatgtaaataagagcaagagagctccaagtgatacaggcacttgggttaaaatcatcaacaagtacatggacacgatgaagcaggcgggttatcaaaatgtgtatgtctatagctatcgtagtttattacagacgcgtttaaaacacccagatattttaaaacatgtaaactgggtagcggcctatacgaatgctttagaatgggaaaaccctcattattcaggaaaaaaaggttggcaatatacctcttctgaatacatgaaaggaatccaagggcgcgtagatgtcagcgtttggtat

SEQ ID NO: 64 - DNA, 474 bp, Streptococcus pneumoniae
atggcaaaagaaccgtggcaagaagatatctatgatcaagaagaatcaagagcagagcgtcggcatcgaaaccacggaggggctgataggatggctaatcgtattttgacgatcctagctagtattttctttgtaattgtggtggtgatggtcatcgttctcatctatctatcatcgggggggagtaatcgcacagcagccttaaaaggctttcatgattctgatgccagtgtagtacaaatctcatcttcaagtagttctcagcctgagcagagttcagagccagaatctacttctagtagttcagaagaagctgctaatcctgaaggaacgattaaagttctcgcaggagaaggggaagcagctattgccgctcgtgcaggaatctccattgctcagttagaggccttgaatcctgggcacatggctacaggatcttggtttgctaatccaggtgatgttataaaaataaaa

SEQ ID NO: 65 - DNA, 786 bp, Streptococcus pneumoniae
atgccaattacatcattagaaataaaggacaagacttttggaactcgattcagaggttttgatccagaagaagtcgatgaatttttagatattgtggttcgtgattacgaagatcttgtgcgtgcgaatcatgataaaaatttgcgtattaagagtttagaagagcgtttgtcttactttgatgaaataaaagattcattgagccagtctgtattgattgctcaggatacagctgagagagtgaaacaggcggcgcatgaacgttcaaacaatatcattcatcaagcagagcaagatgcgcaacgcttgttggaagaagctaaatataaggcaaacgagattcttcgtcaagcaactgataatgctaagaaagtcgctgttgaaacagaagaattgaagaacaagagccgtgtcttccaccaacgtctcaaatctacaattgagagtcagttggctattgttgaatcttcagattgggaagatattctccgtccaacagctacttatcttcaaaccagtgatgaagcctttaaagaagtggttagcgaagtacttggagaaccgattccagctccaattgaagaagaaccaattgatatgacacgtcagttctctcaagcagaaatggcagaattacaagctcgtattgaggtagccgataaagaattgtctgaatttgaagctcagattaaacaggaagtggaagctccaactcctgtagtgagtcctcaagttgaagaagagcctctgctcatccagttggcccaatgtatgaagaaccagaag

SEQ ID NO: 66 - DNA, 537 bp, Streptococcus pneumoniae
atgtctttaaaagatagattcgatagatttatagattattttacggaggatgaggattcaagtctcccttatgaaaaaagagatgagcctgtgtttacttcagtaaattcttcacaggaaccggctctcccaatgaatcaaccttcacagtcggctggcacaaaagagaacaatatcaccagacttcatgcaagacaacaggaattggcaaatcagagtcagcgtgcaacggataaggtcattatagatgttcgttatcctagaaaatatgaggatgcaacagaaattgttgatttattggcaggaaacgaaagtatcttgattgattttcagtatatgacagaggtgcaggctcgtcgttgtttggactatttggatggagcttgtcatgttttagctggaaatttgaaaaaggtagcttctaccatgtatttgttgacaccagtgaacgttattgtaaatgttgaagatatccgtttaccagatgaagatcaacagggtgagttcggttttgatatgaagcgaaatagagtacga

SEQ ID NO: 67 - DNA, 915 bp, Streptococcus pneumoniae
atgtcagatttgaaaaaatacgaaggtgtcattccagccttctacgcatgttatgatgatcaaggagaagtaagcccagaacgtacgcgtgccttggttcaatacttcattgataaaggtgttcaaggtctttatgtcaatggttcttctggtgaatgtatctaccaaagcgttgaagatcgcaagttgattttggaagaagtcatggcggtagccaaaggtaaattgaccattattgcccatgttgcttgcaataatactaaagatagtatggaacttgctcgccatgctgaaagcttgggagtagatgctattgcaacgattccaccaatttatttccgcttgccagaatactcagttgccaaatactggaacgatatcagttctgcagctccaaacacagactacgtgatttacaacattcctcaattggcaggggttgctttgactccaagcctttacacagaaatgttgaaaaatcctcgtgttatcggtgtgaagaactcttctatgccagttcaagatatccaaacctttgtcagccttggtggagaagaccatatcgtctttaatggtcctgatgagcagttcctaggaggacgcctcatgggggctagggctggtatcggtggtacttatggtgctatgccagaactcttcttgaaactcaatcagttgattgcggataaggacctagaaacagcgcgtgaattgcagtatgctatcaacgcaatcattggtaaactcacttctgctcatggaaatatgtacggtgtcatcaaagaagtcttgaaaatcaatgaaggcttgaatattggatctgttcgttcaccattgacaccagtgactgaagaagatcgtccagttgtagaagcggctgctgccttgattcgtgaaaccaaggagcgcttcctc

SEQ ID NO: 68 - DNA, 2091 bp, Streptococcus pneumoniae
atgaataaaagaggtctttattcaaaactaggaatttccgttgtaggcattagtcttttaatgggagtccccactttgattcatgcgaatgaattaaactatggtcaactgtccatatctcctatttttcaaggaggttcatatcaactgaacaataagagtatagatatcagctctttgttattagataaattgtctggagagagtcagacagtagtaatgaaatttaaagcagataaaccaaactctcttcaagctttgtttggcctatctaatagtaaagcaggctttaaaaataattacttttcaattttcatgagagattctggtgagataggtgtagaaataagagacgcccaaaagggaataaattatttattttccagaccagcttcattatggggaaaacataaaggacaggcagttgaaaatacactagtatttgtatctgattctaaagataaaacatacacaatgtatgttaatggaatagaagtgttctctgaaacagttgatacatttttgccaatttcaaatataaatggtatagataaggcaacactaggagctgttaatcgtgaaggtaaggaacattacctcgcaaaaggaagtattgatgaaatcagtctatttaacaaagcaattagtgatcaggaagtttcaactattcccttgtcaaatccatttcagttaattttccaatcaggagattctactcaagctaactattttagaataccgacactatatacattaagtagtggaagagttctatcaagtattgatgcacgttatggtgggactcatgattctaaaagtaagattaatattgccacttcttatagtgatgataatgggaaaacgtggagtgagccaatttttgctatgaagtttaatgactatgaggagcagttagtttactggccacgagataataaattaaagaatagtcaaattagtggaagtgcttcattcatagattcatccattgttgaagataaaaaatctgggaaaacgatattactagctgatgttatgcctgcgggtattggaaataataatgcaaataaagccgactcaggttttaaagaaataaatggtcattattatttaaaactaaagaagaatggagataacgatttccgttatacagttagagaaaatggtgtcgtttataatgaaacaactaataaacctacaaattatactataaatgataagtatgaagttttggagggaggaaagtctttaacagtcgaacaatattcggttgattttgatagtggctctttaagagaaaggcataatggaaaacaggttcctatgaatgttttctacaaagattcgttatttaaagtgactcctactaattatatagcaatgacaactagtcagaatagaggagagagttgggaacaatttaagttgttgcctccgttcttaggagaaaaacataatggaacttacttatgtcccggacaaggtttagcattaaaatcaagtaacagattgatttttgcaacatatactagtggagaactaacctatctcatttctgatgatagtggtcaaacatggaagaaatcctcagcttcaattccgtttaaaaatgcaacagcagaagcacaaatggttgaactgagagatggtgtgattagaacattctttagaaccactacaggtaagatagcttatatgactagtagagattctggagaaacatggtcgaaagtttcgtatattgatggaatccaacaaacttcatatggcacacaagtatctgcaattaaatactctcaattaattgatggaaaagaagcagtcattttgagtacaccaaattctagaagtggccgcaagggaggccaattagttgtcggtttagtcaataaagaagatgatagtattgattggaaataccactatgatattgatttgccttcgtatggttatgcctattctgcgattacagaattgccaaatcatcacataggtgtactgtttgaaaaatatgattcgtggtcgagaaatgaattgcatttaagcaatgtagttcagtatatagatttggaaattaatgatttaacaaaa

SEQ ID NO: 69 - DNA, 2884 bp, Streptococcus pneumoniae
atgaatcggagtgttcaagaacgtaagtgtcgttatagcattaggaaactatcggtaggagcggtttctatgattgtaggagcagtggtatttggaacgtctcctgttttagctcaagaaggggcaagtgagcaacctctggcaaatgaaactcaactttcgggggagagctcaaccctaactgatacagaaaagagccagccttcttcagagactgaactttctggcaataagcaagaacaagaaaggaaagataagcaagaagaaaaaattccaagagattactatgcacgagatttggaaaatgtcgaaacagtgatagaaaaagaagatgttgaaaccaatgcttcaaatggtcagagagttgatttatcaagtgaactagataaactaaagaaacttgaaaacgcaacagttcacatggagtttaagccagatgccaaggccccagcattctataatctcttttctgtgtcaagtgctactaaaaaagatgagtacttcactatggcagtttacaataatactgctactctagaggggcgtggttcggatgggaaacagttttacaataattacaacgatgcacccttaaaagttaaaccaggtcagtggaattctgtgactttcacagttgaaaaaccgacagcagaactacctaaaggccgagtgcgcctctacgtaaacggggtattatctcgaacaagtctgagatctggcaatttcattaaagatatgccagatgtaacgcatgtgcaaatcggagcaaccaagcgtgccaacaatacggtttgggggtcaaatctacagattcggaatctcactgtgtataatcgtgctttaacaccagaagaggtacaaaaacgtagtcaactttttaaacgctcagatttagaaaaaaaactacctgaaggagcggctttaacagagaaaacggacatattcgaaagcgggcgtaacggtaacccaaataaagatggaatcaagagttatcgtattccagcacttctcaagacagataaaggaactttgatcgcaggtgcagatgaacgccgtctccattcgagtgactggggtgatatcggtatggtcatcagacgtagtgaagataatggtaaaacttggggtgaccgagtaaccattaccaacttacgtgacaatccaaaagcttctgacccatcgatcggttcaccagtgaatatcgatatggtgttggttcaagatcctgaaaccaaacgaatcttttctatctatgacatgttcccagaagggaagggaatctttggaatgtcttcacaaaaagaagaagcctacaaaaaaatcgatggaaaaacctatcaaatcctctaccgtgaaggagaaaagggagcttataccattcgagaaaatggtactgtctatacaccagatggtaaggcgacagactatcgcgttgttgtagatcctgttaaaccagcctatagcgacaagggtgatctatacaagggtgaccaattactaggaaatatctacttcacaacaaacaaaacttctccatttagaattgccaaggatagctatctatggatgtcctacagtgatgacgacgggaagacatggtcagctcctcaagatattactccgatggtcaaagccgattggatgaaattcttgggtgtaggtcctggaacaggaattgtacttcggaatgggcctcacaagggacggattttgataccggtttatacgactaataatgtatctcacttagatggctcgcaatcttctcgtgtcatctattcagatgatcatggaaaaacttggcatgctggagaagcggtcaacgataaccgtcaggtagacggtcaaaagatccactcttctacgatgaacaatagacgtgcgcaaaatacagaatcaacggtggtacaactaaacaatggagatgttaaactctttatgcgtggtttgactggagatcttcaggttgctacaagtaaagacggaggagtgacttgggagaaggatatcaaacgttatccacaggttaaagatgtctatgttcaaatgtctgctatccatacgatgcacgaaggaaaagaatacatcatcctcagtaatgcaggtggaccgaaacgtgaaaatgggatggtccacttggcacgtgtcgaagaaaatggtgagttgacttggctcaaacacaatccaattcaaaaaggagagtttgcctataattcgctccaagaattaggaaatggggagtatggcatcttgtatgaacatactgaaaaaggacaaaatgcctataccctatcatttagaaaatttaattgggaatttttgagcaaaaatctgatttctcctaccgaagcgaactagagagatgggcaaaggagagatgggcaaaggagttattggcttggagttcgactcagaagtattggtcaacaaggctccaacccttcaattggcaaatggtaaaacagcgactttcctaacccagtatgatagcaagaccttgttgtttgcagtagataaggaagatatcggacaggaaattattggtatagctaaaggaagcatcgaaagtatgcataatcttcctgtaaatctagcaggtgccagagttcctggcggagtaaatggtagcaaagcagcggtgcatgaagttccagaatttacagggggagttaatggtacagagccagctgttcatgaaatcgcagagtataagggatctgattcgcttgtaactcttactacaaaaaaagattatacttacaaagctcctcttgctcagcaggcacttcctgaaacaggaaacaaggagagtgacctcctagcttcactaggactaacagctttcttccttggtctgtttacgctagggaaaaagagagaacaa

SEQ ID NO: 70 - DNA, 1977 bp, Streptococcus pneumoniae
atgatccaaatcggcaagatttttgccggacgctatcggattgtcaaacagattggtcgaggaggtatggcggatgtctacctagccaaagacttaatcttagatggggaagaagtggcagtgaaggttctgaggaccaactaccagacggacccgatagctgtagctcgttttcagcgtgaagcgagagctatggcagatctagaccatcctcatatcgttcggataacagatattggcgaggaagacggtcaacagtacctagctatggagtatgtggctggactggacctcaaacgctatatcaaggaacattatcctctttctaatgaagaagcagtccgtatcatgggacaaattctcttggctatgcgcttggcccatactcgaggaattgttcacagggacttgaaacctcaaaatatcctcttgacaccagatgggactgccaaggtcacagactttgggattgctgtagcctttgcagagacaagtctgacccagactaactcgatgttgggctcagttcattacttgtcaccagagcaggcgcgtggttcgaaggcgactgtgcagagtgatatctatgccatggggattattttctatgagatgctgacaggccatatcccttatgacggggatagcgcggtgaccattgccctccagcatttccagaaacccctgccgtccgttattgcagaaaatccatctgtacctcaggctttagaaaatgttattatcaaggcaactgctaaaaagttgaccaatcgctaccgctcggtttcagagatgtatgtggacttgtctagtagcttgtcctacaatcgtagaaatgaaagtaagttaatctttgatgaaacgagcaaggcagataccaagaccttgccgaaggtttctcagagtaccttgacatctattcctaaggttcaagcgcaaacagaacacaaatcaatcaaaaacccaagccaggctgtgacagaggaaacttaccaaccacaagcaccgaaaaaacatagatttaagatgcgttacctgattttgttggccagccttgtattggtggcagcttctcttatttggatactatccagaactcctgcaaccattgccattccagatgtggcaggtcagacagttgcagaggccaaggcaacgctcaaaaaagccaattttgagattggtgaggagaagacagaggctagtgaaaaggtggaagaagggcggattatccgtacagatcctggcgctggaactggtcgaaaagaaggaacgaaaatcaatttggttgtctcatcaggcaagcaatctttccaaattagtaattatgtcggtcggaaatcctctgatgtcattgcggaattaaaagagaaaaaagttccagataatttgattaaaattgaggaagaagagtcgaatgagagtgaggctggaacggtcctgaagcaaagtctaccagaaggtacgacctatgacttgagcaaggcaactcaaattgttttgacagtagctaaaaaagctacgacgattcaattagggaactatattggacggaactctacagaagtaatctcagaactcaagcagaagaaggttcctgagaatttgattaagatagaggaagaagagtccagcgaaagcgaaccaggaacgattatgaaacaaagtccaggtgccggaacgacttatgatgtgagtaaacctactcaaattgtcttgacagtagctaaaaaagttacaagtgttgccatgccgagttacattggttctagcttggagtttactaagaacaatttgattcaaattgttgggattaaggaagctaatatagaagttgtagaagtgacgacagcgcctgcaggtagtgcagaaggcatggttgttgaacaaagtcctagagcaggtgaaaaggtagacctcaataagactagagtcaagatttcaatctacaaacctaaaacaacttcagctactcct

SEQ ID NO: 71 - DNA, 933 bp, Streptococcus pneumoniae
atgacaaaactaatctttatggggacccccgacttttcagcaacagtcttaaaaggacttttgacagatgaccgttacgaaattctagccgttgtgacccagccagaccgtgctgttggtcgtaaaaaagttatccaagaaaccccagtcaagcaggctgccaaggaagcaggactatctatctaccaacctgaaaaattatctggaagtccagagatggaagatcttatgaagctaggagcagatggaattgtgactgctgcttttgggcagtttctcccaagcaaactccttgatagcatggactttgctgtcaacgttcatgcctccctccttcctagacaccgtggtggtgcgcctatccattatgccttgattcaaggggatgaggaagctggtgtgaccatcatggaaatggttaaggaaatggatgcaggagatatgatttctcgtcgcagcattccgatcacagatgaggacaatgttggcaccttgtttgaaaaattggcgctagttggtcgtgatttgcttttggacactctgcctgcctatattgctggtgatatcaaacctgaaccgcaggatacgagtcaggttaccttctctccaaatataaagccagaggaagaaaaactggactggaacaaaaccaatcgtcaactctttaaccaaattcgtggaatgaacccctggcctgttgcccatactttccttaagggcgaccgctttaagatttatgaagccctaccagtagaaggtcagggaaatccaggtgagattctctctatcggcaagaaagaattgattgtcgcaacggctgaaggggctctatccctcaaacaagtgcagccagctggtaagcctaagatggacattgcttccttcctcaacggagttggacgtacattgactgtaggagaacgatttggtgac

SEQ ID NO: 72 - DNA, 2370 bp, Streptococcus pneumoniae
gtgtttagacgtttaggtcaagatttccagcttaggaaagtgaaaaagattttaaagcagattaatgccctgaaaggcaagatgtcctctctttcggatcaagaattagtagctaaaacagtagagtttcgtcagcgtctttccgagggagaaagtctagacgatattttggttgaagcttttgctgtggtgcgtgaagcagataagcggattttagggatgtttccttatgatgttcaagtcatgggagctattgtcatgcactatggaaatgttgctgagatgaatacgggggaaggtaagaccttgacagctaccatgcctgtctatttgaacgctttttcaggagaaggagtgatggttgtgactcctaatgagtatttatcaaagcgtgatgccgaggaaatgggtcaagtttatcgttttctaggattgaccattggtgtaccatttacggaagatccaaagaaggagatgaaagctgaagaaaagaagcttatctatgcttcggatatcatctacacaaccaatagtaatttaggttttgattatctaaatgataacctagcctcgaatgaagaaggtaagtttttacgaccgtttaactatgtgattattgatgaaattgatgatatcttgcttgatagtgcacaaactcctctgattattgcgggttctcctcgtgttcagtctaattactatgcgatcattgatacacttgtaacaaccttggtcgaaggagaggattatatctttaaagaggagaaagaggaggtttggctcactactaagggggccaagtctgctgagaatttcctagggattgataatttatacaaggaagagcatgcgtcttttgctcgtcatttggtttatgcgattcgagctcataagctctttactaaagataaggactatatcattcgtggaaatgagatggtactggttgataagggaacagggcgtctaatggaaatgactaaacttcaaggaggtctccatcaggctattgaagccaaggaacatgtcaaattatctcctgagacgcgggctatggcctcgatcacctatcagagtctttttaagatgtttaataagatatctggtatgacagggacaggtaaggtcgcggaaaaagagtttattgaaacttacaatatgtctgtagtacgcattccaaccaatcgtccgagacaacggattgactatccagataatctatatatcactttacctgaaaaagtgtatgcatccttggagtacatcaagcaataccatgctaagggaaatcctttactcgtttttgtaggctcagttgaaatgtctcaactctattcgtctctcttgtttcgtgaagggattgcccataatgtcctaaatgctaataatgcggcgcgtgaggctcagattatctccgagtcaggtcagatgggggctgtgacagtggctacctctatggcaggacgtggtacggatatcaagcttggtaaaggagtcgcagagcttgggggcttgattgttattgggactgagcggatggaaagtcagcggatcgacctacaaattcgtggccgttctggtcgtcagggagatcctggtatgagtaaattttttgtatccttagaggatgatgttatcaagaaatttggtccatcttgggtgcataaaaagtacaaagactatcaggttcaagatatgactcaaccggaagtattgaaaggtcgtaaataccggaaactagtcgaaaaggctcagcatgccagtgatagtgctggacgttcagcacgtcgtcagactctggagtatgctgaaagtatgaatatacaacgggatatagtctataaagagagaaatcgtctaatagatggttctcgtgacttagaggatgttgttgtggatatcattgagagatatacagaagaggtagcggctgatcactatgctagtcgtgaattattgtttcactttattgtgaccaatattagttttcatgttaaagaggttccagattatatagatgtaactgacaaaactgcagttcgtagctttatgaagcaggtgattgataaagaactttctgaaaagaaagaattacttaatcaacatgacttatatgaacagtttttacgactttcactgcttaaagccattgatgacaactgggtagagcaggtagactatctacaacagctatccatggctatcggtggtcaatctgctagtcagaaaaatccaatcgtagagtactatcaagaagcctacgcgggctttgaagctatgaaagaacagattcatgcggatatggtgcgtaatctcctgatggggctggttgaggtcactccaaaaggtgaaatcgtgactcattttcca

SEQ ID NO: 73 - DNA, 14328 bp, Streptococcus pneumoniae
atgaccgaaacggtagaagataaagtaagtcattcaattactgggcttgatatcctcaaggggatagttgctgcgggagctgtcataagtggaaccgttgcaactcaaacgaaggtatttacaaatgagtcagcagtacttgaaaaaactgtagagaaaacggatgctttggcaacaaatgatacagtagttctaggtacgatatctacaagtaattcagcgagttcaactagtttgtcagcttcagagtcggcaagtacatctgcatctgagtcagcctcaaccagcgcttcgacctcagcaagtacaagtgcatcagaatcagcaagtacatcggcttcgacaagtatttctgcatcatctactgtggtaggttcacaaacagctgccgctacagaagcaactgctaagaaggtcgaagaagatcgtaagaaaccagctagtgattatgtagcatcagttacaaatgtcaatctccaatcttatgctaagcgacgcaagcgttcagtggattccatcgagcaattgctggcttctataaaaaatgctgctgttttttctggcaatacgattgtaaatggcgcccctgcaattaatgcaagtctaaacattgctaaaagtgagacaaaagtttatacaggtgaaggtgtagattcggtatatcgtgttccaatttactataaattgaaagtgacaaatgatggttcaaaattgacctttacctatacggttacgtatgtgaatcctaaaacaaatgatcttggtaatatatcaagtatgcgtcctggatattctatctataattcaggtacttcaacacaaacaatgttaacccttggcagtgatcttggtaaaccttcaggtgtaaagaactacattactgacaaaaatggtagacaggttctatcctataatacatctacaatgacgacgcagggtagtgggtatacttggggaaatggtgcccaaatgaatggtttctttgctaagaaaggatatggattaacatcatcttggactgtaccaattactggaacggatacatcctttacatttaccccttacgctgctagaacagatagaattggaattaactacttcaatggtggaggaaaggtagttgaatctagcacgaccagtcagtcactttcacagtctaagtcactctcagtaagtgctagtcaaagcgcctcagcttcagcatcaacaagtgcgtcggcttcagcatcaaccagtgcctcggcttcagcgtcaaccagtgcgtcagcttcagcaagtaccagtgcttcagtctcagcatcaacaagtgcttcagcctcagcatcgacaagtgcctcggcttcagcaagcacatcagcatctgaatcagcgtcaaccagtgcttcggcttcagcaagtaccagtgcttcagcttcagcatcaaccagcgcctcggcctcagcaagcacctcagcttctgaatcggcctcaaccagcgcctcggcctcagcaagcacctcagcttctgaatcggcctcaaccagcgcctcagcctcagcatcaacgagtgcttcggcttcagcaagcacaagcgcctcgggttcagcatcaacgagtacgtcagcttcagcgtcaaccagtgcttcagcctcagcatcaacaagtgcgtcagcctcagcaagtatctcagcgtctgaatcggcatcaacgagtgcgtctgagtcagcatcaacgagtacgtcagcctcagcaagcacctcagcttctgaatcggcctcaaccagtgcgtcagcctcagcatcgacaagcgcctcagcttcagcaagtaccagtgcttcagcctcagcgtcgacaagtgcgtcggcctcaaccagtgcatctgaatcggcatcaaccagtgcgtcagcctcagcaagtactagtgcatcggcttcagcatcaaccagtgcctcggcttcagcgtcaaccagtgcgtcagcttcagcaagtaccagtgcttcagtctcagcatcaacaagtgcttcagcctcagcatcgacaagtgcctcggcttcagcaagcacatcagcatctgaatcagcgtcgacaagcgcctcagcttcagcaagtaccagtgcgtcagcctcagcgtcgacaagtgcgtcagcctcagcaagtactagtgcatcagcttcagcatcaacgagtgcatcggcttcggcgtcaaccagtgcatcagagtcagcaagtaccagtgcgtcagcttccgcatcaacaagtgcctcggcttcagcaagcaccagtgcgtcggcttcagcaagtactagcgcctcagcctcagcctcaaccagtgcgtcagcctcagcaagtatctcagcgtctgaatcggcatcaacgagtgcgtccgcttcagcaagtactagcgcctcagcctcagcgtcaacaagtgcatcggcttcagcgtcaacgagtgcgtctgaatcggcatcaacgagtgcgtccgcttcagcaagtactagcgcctcagcctcagcgtcaacaagtgcatcggcttcagcatcaacgagtgcgtccgcttcagcaagtactagcgcctcagcctcagcgtcaacaagtgcatcggcttcagcgtcaacgagtgcgtctgagtcagcatcaacgagtgcgtcagcctcagcaagcacatcagcttctgaatctgcatcaaccagtgcgtcagcctcagcatcgacaagcgcctcagcttcagcaagtaccagtgcgtcagcctcagcgtcgacaagtgcgtcggcttcagcaagtaccagtgcgtcagcctcagcaagtaccagtgcgtcagcctcagcgtcgacaagtgcgtcggcctcaaccagtgcatctgaatcggcatcaaccagtgcgtcagcctcagcaagtactagtgcatcagcttcagcatcaacgagtgcatcggcttcagcatcaaccagtgcatcagagtcagcaagtaccagtgcgtcagcttccgcatcaacaagtgcctcggcttcagcaagtactagcgcctcagcctcagcgtcaacaagtgcttcagcttccgcgtcaaccagcgcctcggcctcagcaagtatctcagcgtctgaatcggcatcaacaagtgcctcggcttcagcatcaacgagtgcatcagtctcagcaagcaccagtgcgtcggcctcagcaagcaccagcgcgtctgaatccgcatcaaccagtgcctcagcttcagcaagtacctcagcatctgaatcagcatcaacaagtgcctcggcttcagcaagcacaagtgcttcagcctcagcaagtatctcagcgtctgaatcggcatcaacgagtgcgtccgcttcagcaagtactagcgcctcagcatcagcgtcaacaagtgcttcggcttcagcgtcaacgagtgcgtctgagtcagcatcaacgagtacgtcagcctcagcaagcacatcagcttctgaatctgcatcaaccagtgcgtcagcctcagcatcgacaagcgcctcagcttcagcaagtaccagtgcgtcagcctcagcaagtaccagtgcttcagcctcagcgtcgacaagtgcgtcggcctcaaccagtgcatctgaatcggcatcaaccagtgcgtcagcctcagcaagtactagcgcctcagcctcagcatcaacgagtgcgtccgcttcagcaagtactagtgcatcagcttcagcaagtactagcgcctcagcctcagcgtcgacaagcgcctcagcttcagcaagtaccagtgcgtcagcctcagcgtcgacaagtgcgtcggcttcagcaagtacctcagcgtctgaatcagcatcaacaagtgcgtcggcttcagcatcaacgagtgcatcagcttcagcatcaacaagtgcttcagcttcagcaagtaccagtgcgtcggcttcagcatcaacgagtgcttcagtctcagcgtcaaccagtgcctctgaatccgcatcaacaagtgcctcggcttcagcaagcaccagtgcttcggcttcagcgtcaacgagtgcgtctgagtcagcatcaacgagtgcgtcagcctcagcaagcacatcagcttctgaatctgcatcaaccagtgcgtcagcttccgcatcaacaagcgcctcggcctcagcaagtacaagtgcttcagcctcagcatcaaccagtgcatcagcttcagcctcaacaagtgcttcagcctcagcgtcaaccagtgcctcggcttcagcaagtaccagtgcgtcagcttcagcaagcacaagtgcgtcagcttcagcatcaaccagtgcttcggcttcggcatcaacaagtgcctcagcatcagcatcaacgagtgcgtcagcctcagcaagtactagtgcatcagcatcagcatcaaccagtgcatcagcctcagcaagtatctcagcgtctgaatcggcatcaacgagtgcatcagcatcagcatcaacgagtgcatcggcttcagcgtcaaccagtgcatcagtctcagcaagcaccagtgcgtcggcttcagcatcaacgagtgcctcagcctcagcaagtatctcagcgtctgaatcggcatcaacgagtgcgtcagcctcagcaagtactagtgcatcggcttcagcaagcaccagtgcgtcggcttcagcatcaaccagtgcctcagcctcagcaagtatctcagcgtctgaatcggcatcaacgagtgcgtcagcctcagcaagtactagtgcatcagcatcagcatcaacgagtgcatcggcttcagcaagtaccagcgcctcagcttcagcaagcaccagtgcgtcagcctcagcaagtaccagcgcctcagcctcagcaagcaccagtgcctcagcttcagcaagtaccagtgcgtcagcctcagcgtcgacaagtgcgtcggcttcagcaagtacctcagcgtctgaatcagcatcaacgagtgcatcagcttcagcatcaacaagtgcttcagcttcagcaagtaccagtgcgtcggcttcagcatcaacgagtgcttcagtctcagcgtcaaccagtgcctctgaatcagcatcaacaagtgcctcggcttcagcaagcaccagtgcgtcggcttcagcaagtactagtgcatcggcttcagcatcgacaagtgcgtctgaatcggcatcaacgagtgcttcggcttcagcatcaacgagtgcgtcagcctcagcaagcacatcagcttctgaatctgcatcaaccagtgcgtccgcttcagcgtcaaccagtgcgtcggcttcagcgtcgacaagtgcttcggcttcagcatcaacgagtgcgtcggcctcagcaagcgcaagtacctcagcgtcagcttccgcctcaaccagtgcgtcggcttcagcaagcacaagtgcgtcagcctcagcaagtatctcagcgtctgaatcggcatcaacgagtgcgtctgagtcagcatcaacgagtacgtcagcctcagcaagcacatcagcttctgaatctgcatcaaccagtgcgtcagcctcagcatcgacaagcgcctcagcttcagcaagtaccagtgcttcagcctcagcgtcgacaagtgcgtcggcctcaaccagtgcatctgaatcggcatcaaccagtgcgtcagcctcagcaagtactagtgcatcagcttcagcatcaacgagtgcatcggcttcagcatcaaccagtgcctcggcttcagcgtcaaccagtgcgtcagcttcagcaagtaccagtgcttcagtctcagcatcaacaagtgcttcagcctcagcatcgacaagtgcctcggcttcagcaagcacatcagcatctgaatcagcgtcgacaagcgcctcagcttcagcaagtaccagtgcgtcagcctcagcgtcgacaagtgcgtcagcctcagcaagtactagtgcatcagcttcagcatcaacgagtgcatcggcttcggcgtcaaccagtgcatcagagtcagcaagtaccagtgcgtcagcttccgcatcaacaagtgcctcggcttcagcaagcaccagtgcgtcggcttcagcaagtactagcgcctcagcctcagcctcaaccagtgcgtcagcctcagcaagtatctcagcgtctgaatcggcatcaacgagtgcgtccgcttcagcaagtactagcgcctcagcctcagcgtcaacaagtgcatcggcttcagcgtcaacgagtgcgtctgaatcggcatcaacgagtgcgtccgcttcagcaagtactagcgcctcagcctcagcgtcaacaagtgcatcggcttcagcatcaacgagtgcgtccgcttcagcaagtactagcgcctcagcctcagcgtcaacaagtgcatcggcttcagcgtcaacgagtgcgtctgagtcagcatcaacgagtgcgtcagcctcagcaagcacatcagcttctgaatctgcatcaaccagtgcgtcagcctcagcatcgacaagcgcctcagcttcagcaagtaccagtgcgtcagcctcagcgtcgacaagtgcgtcggcttcagcaagtaccagtgcgtcagcctcagcaagtaccagtgcgtcagcctcagcgtcgacaagtgcgtcggcctcaaccagtgcatctgaatcggcatcaaccagtgcgtcagcctcagcaagtactagtgcatcagcttcagcatcaacgagtgcatcggcttcagcatcaaccagtgcatcagagtcagcaagtaccagtgcgtcagcttccgcatcaacaagtgcctcggcttcagcaagtactagcgcctcagcctcagcgtcaacaagtgcttcagcttccgcgtcaaccagcgcctcggcctcagcaagtatctcagcgtctgaatcggcatcaacaagtgcctcggcttcagcatcaacgagtgcatcagtctcagcaagcaccagtgcgtcggcctcagcaagcaccagcgcgtctgaatccgcatcaaccagtgcctcagcttcagcaagtacctcagcatctgaatcagcatcaacaagtgcatcggcttcagcaagcacaagtgcttcagcctcagcaagtatctcagcgtctgaatcggcatcaacgagtgcgtccgcttcagcaagtactagcgcctcagcatcagcgtcaacaagtgcttcggcttcagcgtcaacgagtgcgtctgagtcagcatcaacgagtacgtcagcctcagcaagcacatcagcttctgaatctgcatcaaccagtgcgtcagcctcagcatcgacaagcgcctcagcttcagcaagtaccagtgcgtcagcctcagcaagtaccagtgcttcagcctcagcgtcgacaagtgcgtcggcctcaaccagtgcatctgaatcggcatcaaccagtgcgtcagcctcagcaagtactagcgcctcagcctcagcatcaacgagtgcgtccgcttcagcaagtactagtgcatcagcatcagcatcaacgagtgcatcggcttcagcaagtaccagcgcctcagcttcagcaagcaccagtgcgtcagcctcagcaagtaccagcgcctcagcctcagcaagcaccagtgcctcagcttcagcaagtaccagtgcgtcagcctcagcgtcgacaagtgcgtcggcttcagcaagtacctcagcgtctgaatcagcatcaacgagtgcatcagcttcagcatcaacaagtgcttcagcttcagcaagtaccagtgcgtcggcttcagcatcaacgagtgcttcagtctcagcgtcaaccagtgcctctgaatcagcatcaacaagtgcctcggcttcagcaagcaccagtgcgtcggcttcagcaagtactagtgcatcggcttcagcatcgacaagtgcgtctgaatcggcatcaacgagtgcttcggcttcagcatcaacgagtgcgtcagcctcagcaagcacatcagcttctgaatctgcatcaaccagtgcgtccgcttcagcgtcaaccagtgcgtcggcttcagcgtcgacaagtgcttcggcttcagcatcaacgagtgcgtcggcctcagcaagcgcaagtacctcagcgtcagcttccgcctcaaccagtgcgtccgcttcagcaagcacaagtgcgtcagcctcagcaagtatctcagcgtctgaatcggcatcaacgagtgcgtcggcctcagcaagcgcaagtacctcagcgtcagcttccgcctcaaccagtgcgtcggcttcagcaagcacaagtgcgtcagcctcagcaagtatctcagcgtctgaatcggcatcaacgagtgcgtctgagtcagcatcaacgagtacgtcagcctcagcaagcacatcagcttctgaatcggcatcaaccagtgcgtcagcctcagcatcgacaagcgcctcagcttcagcaagtaccagtgcttcagcctcagcgtcgacaagtgcgtcggcctcaaccagtgcatctgaatcggcatcaaccagtgcgtcagcctcagcaagtactagtgcatcagcttcagcatcaacgagtgcatcggcttcagcatcaaccagtgcctcggcttcagcgtcaaccagtgcgtcagcttcagcaagtaccagtgcttcagtctcagcatcaacaagtgcttcagcctcagcatcgacaagtgcctcggcttcagcaagcacatcagcatctgaatcagcgtcgacaagtgcgtcggcctcaaccagtgcatctgaatcggcatcaaccagtgcgtcagcctcagcaagtactagtgcatcagcttcagcatcaacgagtgcatcggcttcggcgtcaaccagtgcatcagagtcagcaagtaccagtgcgtcagcttccgcatcaacaagtgcctcggcttcagcaagcacatcagcatctgaatcagcgtcaaccagtgcttcggcttcagcaagtaccagtgcttcagcttcagcatcaaccagcgcctcggcctcagcaagcacctcagcttctgaatcggcctcaaccagcgcctcggcctcagcaagcacctcagcttctgaatcggcctcaaccagcgcctcagcctcagcatcaacgagtgcttcggcttcagcaagcacaagcgcctcgggttcagcatcaacgagtacgtcagcttcagcgtcaaccagtgcttcagcctcagcatcaacaagtgcgtcagcctcagcaagtatctcagcgtctgaatcggcatcaacgagtgcgtctgagtcagcatcaacgagtacgtcagcctcagcaagcacctcagcttctgaatcggcctcaaccagtgcgtcagcctcagcatcgacaagcgcctcagcttcagcaagtaccagtgcttcagcctcagcgtcgacaagtgcgtcggcctcaaccagtgcatctgaatcggcatcaaccagtgcgtcagcctcagcaagtactagtgcatcggcttcagcatcaaccagtgcctcggcttcagcgtcaaccagtgcgtcagcttcagcaagtaccagtgcttcagtctcagcatcaacaagtgcttcagcctcagcatcgacaagtgcctcggcttcagcaagcacatcagcatctgaatcagcgtcgacaagcgcctcagcttcagcaagtaccagtgcgtcagcctcagcgtcgacaagtgcgtcagcctcagcaagtactagtgcatcagcttcagcatcaacgagtgcatcggcttcggcgtcaaccagtgcatcagagtcagcaagtaccagtgcgtcagcttccgcatcaacaagtgcctcggcttcagcaagcaccagtgcgtcggcttcagcaagtactagcgcctcagcctcagcctcaaccagtgcgtcagcctcagcaagtatctcagcgtctgaatcggcatcaacgagtgcgtccgcttcagcaagtactagcgcctcagcctcagcgtcaacaagtgcatcggcttcagcgtcaacgagtgcgtctgaatcggcatcaacgagtgcgtccgcttcagcaagtactagcgcctcagcctcagcgtcaacaagtgcatcggcttcagcatcaacgagtgcgtccgcttcagcaagtactagcgcctcagcctcagcgtcaacaagtgcatcggcttcagcgtcaacgagtgcgtctgagtcagcatcaacgagtgcgtcagcctcagcaagcacatcagcttctgaatctgcatcaaccagtgcgtcagcctcagcatcgacaagcgcctcagcttcagcaagtaccagtgcgtcagcctcagcgtcgacaagtgcgtcggcttcagcaagtaccagtgcgtcagcctcagcaagtaccagtgcgtcagcctcagcgtcgacaagtgcgtcggcctcaaccagtgcatctgaatcggcatcaaccagtgcgtcagcctcagcaagtactagtgcatcagcttcagcatcaacgagtgcatcggcttcagcatcaaccagtgcatcagagtcagcaagtaccagtgcgtcagcttccgcatcaacaagtgcctcggcttcagcaagtactagcgcctcagcctcagcgtcaacaagtgcttcagcttccgcgtcaaccagcgcctcggcctcagcaagtatctcagcgtctgaatcggcatcaacaagtgcctcggcttcagcatcaacgagtgcatcagtctcagcaagcaccagtgcgtcggcctcagcaagcaccagcgcgtctgaatccgcatcaaccagtgcctcagcttcagcaagtacctcagcatctgaatcagcatcaacaagtgcctcggcttcagcaagcacaagtgcttcagcctcagcaagtatctcagcgtctgaatcggcatcaacgagtgcgtccgcttcagcaagtactagcgcctcagcatcagcgtcaacaagtgcttcggcttcagcgtcaacgagtgcgtctgagtcagcatcaacgagtacgtcagcctcagcaagcacatcagcttctgaatctgcatcaaccagtgcgtcagcctcagcatcgacaagcgcctcagcttcagcaagtaccagtgcgtcagcctcagcaagtaccagtgcttcagcctcagcgtcgacaagtgcgtcggcctcaaccagtgcatctgaatcggcatcaaccagtgcgtcagcctcagcaagtactagcgcctcagcctcagcatcaacgagtgcgtccgcttcagcaagtactagtgcatcagcttcagcaagtactagcgcctcagcctcagcgtcgacaagcgcctcagcttcagcaagtaccagtgcgtcagcctcagcgtcgacaagtgcgtcggcttcagcaagtacctcagcgtctgaatcagcatcaacaagtgcgtcggcttcagcatcaacgagtgcatcagcttcagcatcaacaagtgcttcagcttcagcaagtaccagtgcgtcggcttcagcatcaacgagtgcttcagtctcagcgtcaaccagtgcctctgaatccgcatcaacaagtgcctcggcttcagcaagcaccagtgcttcggcttcagcgtcaacgagtgcgtctgagtcagcatcaacgagtgcgtcagcctcagcaagcacatcagcttctgaatctgcatcaaccagtgcgtcagcttccgcatcaacaagcgcctcggcctcagcaagtacaagtgcttcagcctcagcatcaaccagtgcatcagcttcagcctcaacaagtgcttcagcctcagcgtcaaccagtgcctcggcttcagcaagtaccagtgcgtcagcttcagcaagcacaagtgcgtcagcttcagcatcaaccagtgcttcggcttcggcatcaacaagtgcctcagcatcagcatcaacgagtgcgtcagcctcagcaagtactagtgcatcagcatcagcatcaaccagtgcatcagcctcagcaagtatctcagcgtctgaatcggcatcaacgagtgcatcagcatcagcatcaacgagtgcatcggcttcagcgtcaaccagtgcatcagtctcagcaagcaccagtgcgtcggcttcagcatcaacgagtgcctcagcctcagcaagtatctcagcgtctgaatcggcatcaacgagtgcgtcagcctcagcaagtactagtgcatcggcttcagcaagcaccagtgcgtcggcttcagcatcaaccagtgcctcagcctcagcaagtatctcagcgtctgaatcggcatcaacgagtgcgtcagcctcagcaagtactagtgcatcagcatcagcatcaacgagtgcatcggcttcagcaagtaccagcgcctcagcttcagcaagcaccagtgcgtcagcctcagcaagtaccagcgcctcagcctcagcaagcaccagtgcctcagcttcagcaagtaccagtgcgtcagcctcagcgtcgacaagtgcgtcggcttcagcaagtacctcagcgtctgaatcagcatcaacgagtgcatcagcttcagcatcaacaagtgcttcagcttcagcaagtatctcagcgtctgaatcggcatcaacgagtgcgtccgcttcagcaagtactagcgcctcagcatcagcgtcaacaagtgcttcggcttcagcgtcaacgagtgcgtctgagtcagcatcaacgagtacgtcagcctcagcaagcacatcagcttctgaatctgcatcaaccagtgcgtcagcctcagcatcgacaagcgcctcagcttcagcaagtaccagtgcgtcagcctcagcaagtaccagtgcttcagcctcagcgtcgacaagtgcgtcggcctcaaccagtgcatctgaatcggcatcaaccagtgcgtcagcctcagcaagtactagcgcctcagcctcagcatcaacgagtgcgtccgcttcagcaagtactagtgcatcagcttcagcaagtactagcgcctcagcctcagcgtcgacaagcgcctcagcttcagcaagtaccagtgcgtcagcctcagcgtcgacaagtgcgtcggcttcagcaagtacctcagcgtctgaatcagcatcaacaagtgcgtcggcttcagcatcaacgagtgcatcagcttcagcatcaacaagtgcttcagcttcagcaagtaccagtgcgtcggcttcagcatcaacgagtgcttcagtctcagcgtcaaccagtgcctctgaatccgcatcaacaagtgcctcggcttcagcaagcaccagtgcttcggcttcagcgtcaacgagtgcgtctgagtcagcatcaacgagtgcgtcagcctcagcaagcacatcagcttctgaatctgcatcaaccagtgcgtcagcttccgcatcaacaagcgcctcggcctcagcaagtacaagtgcttcagcctcagcatcaaccagtgcatcagcttcagcctcaacaagtgcttcagcctcagcgtcaaccagtgcctcggcttcagcaagtaccagtgcgtcagcttcagcaagcacaagtgcgtcagcttcagcatcaaccagtgcttcggcttcggcatcaacaagtgcctcagcatcagcatcaacgagtgcgtcagcctcagcaagtactagtgcatcagcatcagcatcaaccagtgcatcagcctcagcaagtatctcagcgtctgaatcggcatcaacgagtgcatcagcatcagcatcaacgagtgcatcggcttcagcgtcaaccagtgcatcagtctcagcaagcaccagtgcgtcggcttcagcatcaacgagtgcctcagcctcagcaagtatctcagcgtctgaatcggcatcaacgagtgcgtcagcctcagcaagtactagtgcatcggcttcagcaagcaccagtgcgtcggcttcagcatcaaccagtgcctcagcctcagcaagtatctcagcgtctgaatcggcatcaacgagtgcgtcagcctcagcaagtactagtgcatcagcctcagcatcaacgagtgcatcggcttcagcaagtaccagcgcctcagcttcagcaagcaccagtgcgtcagcctcagcaagtaccagcgcctcagcctcagcaagcaccagtgcctcagcttcagcaagtaccagtgcgtcagcctcagcatcaacaagtgcttcagcttcggcctcaacaagtgcgtcagcttcagcatcaacgagtgcgtcggcttcagcaagcaccagtgcctcggcctcagcaagcaccagtgcttcagcttcagcatcaacaagtgcgtcagcttcagcaagtacatcagtttcaaattcagcaaaccattcgaactcacaagttggaaatacttctggatcgacaggtaaatcccaaaaagaattgcctaatacaggtactgagtcgtcaattggatctgtgttacttggagttctagcagctgttacaggtattggattggttgcgaaacgccgtaaacgtgatgaagaagag

SEQ ID NO: 74 - DNA, 606 bp, Streptococcus pneumoniae
atgtcaaacgaaaaaaacacaaacactaacgtagaaaagaaagatgctactgttgtagctcacgaaatcaaaggggaacttacttacgaagataaagttatccaaaaaatcattggtctttcactagaaaacgtttcaggtcttttgggaatcgatggtggtttcttctcaaatcttaaagaaaaaatcgttaacagcgatgacgtaacaagtggtgttaacgtagaagttggtaaaacacaagttgcagttgacttaaacgttattgttgagtaccaaaaaaatgttccagctttatattcagaaatcagagaaatcgtatcttcagaagttgctaaaatgactgacttggaaattgttgaaatcaacgtaaacgttgtcgacatcaaaactaaagaacagcatgaagcagactcagtaagccttcaagatcgcgtatctgacgttgctgaatcaacaggagaattcacttcagaacaattcgaaaaagctaaatctggtcttggatctggtttctcaactgttcaagaaaaagttagcgaaggtgtagaagctgttaaaggtgcagcaaatggtgtagtatctcacgaaaacactcgtgtaaac

SEQ ID NO: 75 - DNA, 1065 bp, Streptococcus pneumoniae
atgacaaaagaaaaaaatgtaattttgactgctcgcgatattgtcgtggaatttgacgttcgtgacaaagtattgacagccattcgcggcgtttcccttgaactagtcgaaggagaagtattagccttggtaggtgagtcaggatcaggtaaatctgttttgacaaagaccttcacaggtatgctcgaagaaaatggtcgtattgcccaaggtagtattgactaccgtggtcaggacttgacagctttatcttctcacaaggattgggaacaaattcgtggtgctaagattgcgactatcttccaggacccaatgactagtttggaccccattaaaacaattggtagtcagattacagaagttattgtaaaacaccaaggaaaaacagctaaagaagcgaaagaattggccattgactacatgaataaggttggcattccagacgcagatagacgttttaatgaatacccattccaatattctggaggaatgcgtcaacgtatcgttattgctattgcccttgcctgccgacctgatgtcttgatctgtgatgagccaacaactgccttggatgtaactattcaagctcagattattgatttgctaaaatctttacaaaacgagtatcatttcacaacaatctttattacccacgaccttggtgtggtggcaagtattgcggataaggtagcggttatgtatgcaggagaaatcgttgagtatggaacggttgaggaagtcttctatgaccctcgccatccatatacatggagtctcttgtctagcttgcctcagcttgctgatgataaaggggatctttactcaatcccaggaacacctccgtcactttatactgacctgaaaggggatgcttttgccttgcgttctgactacgcaatgcagattgacttcgaacaaaaagctcctcaattctcagtatcagagacacattgggctaaaacttggcttcttcatgaggatgctccgaaagtagaaaaaccagctgtgattgcaaatctccatgataagatccgtgaaaaaatgggatttgcccatctggctgac

SEQ ID NO: 76 - DNA, 1977 bp, Streptococcus pneumoniae
atgaaaaaaaatcgtgtatttgctacagcaggtcttgttttattagcagcaggtgtacttgcagcatgcagttcttcaaaatcatctgattcatcagcccctaaagcttatggctatgtttatacagcagacccagaaaccttggactacctgatttcaagtaaaaatagtacaacagtagtgacttcaaatgggattgatggtttattcactaacgataattacggtaatcttgctcctgcagttgcagaggattgggaagtctctaaggatggtttgacctacacttataagattcgtaaaggggttaaatggtttacctctgatggagaagaatatgcagaggtgacggctaaagatttcgtgaacggtttaaaacacgcagcagataaaaaatcagaagctatgtatttagctgaaaattcggttaaaggcttggcagattatctatcaggaacttcaacagatttttcaacagttggtgtcaaggcggttgatgattatacgttacaatacactttgaaccagcctgaaccgttctggaactctaagttgacctattctattttctggcctctgaatgaagaattcgaaacatcaaaaggaagcgattttgctaaaccaacagatccgacatccttgctttataatggtccattcttgttgaaagggttgactgcaaaatcttctgtagagtttgtaaaaaatgagcaatattgggataaagaaaatgtccacctagatactatcaatctagcttactatgatggatcagatcaggagtcgctagagcgtaacttcactagtggagcttatagttatgcccgtctttaccctaccagctccaactattctaaggttgcagaagaatacaaggacaatatctattacacacaatcaggctctgggattgctggtctgggtgtgaatattgatcgccaaagttacaactatacttctaaaactacagattcagagaaagtagctactaagaaggcattgcttaacaaagatttccgtcaagccttgaattttgctcttgatcgctcagcttactcagctcaaatcaatggtaaagatggagcagctttagcagttcgtaatttatttgtaaaaccagactttgtttcagctggtgagaagacctttggtgatttagtcgctgctcaacttcctgcttatggtgatgagtggaaaggtgtgaatttagctgatgggcaggatggtttattcaatgctgacaaggccaaggcagagtttgcgaaagctaagaaagctttagaagcagacggcgttcagtttcctattcatctggacgttccagtagaccaagcatcaaaaaactacatatctcgtattcagtcctttaaacaatctgtagaaacagttcttggtgttgaaaatgtcgttgttgatattcaacaaatgacaagtgatgaattccttaatattacttactatgctgccaatgcttcatctgaggattgggatgtatcaggaggagtttcatgggggccagactatcaagacccatctacttacctggatattttaaaaacaactagcagtgaaactacaaaaacatatttaggatttgataatccaaatagcccttcagtagttcaagttggtttgaaagaatacgataaattagttgatgaagctgccagagagacaagcgacttgaatgtccgttatgaaaaatatgcagcggctcaagcatggttgacagatagttcactctttattcctgctatggcttcttctggtgcagcaccagtgctttcacgaattgttccatttactggagcttctgcgcaaacaggctctaaggggtcagatgtttacttcaaatatttgaaatcacaagataaagtggtgactaaggaagagtatgaaaaagctcgtgaaaaatggttgaaagaaaaagctgaatcaaatgagaaagctcaaaaagaattggcaagtcatgtgaag

SEQ ID NO: 77 - DNA, 954 bp, Streptococcus pneumoniae
atggaaattaatgtgagtaaattaagaacagatttgcctcaagtcggcgtgcaaccatataggcaagtacacgcacactcaactgggaatccgcattcaaccgtacagaatgaagcggattatcactggcggaaagacccagaattaggttttttctcgcacattgttgggaacggttgcatcatgcaggtaggacctgttgataatggtgcctgggacgttgggggcggttggaatgctgagacctatgcagcggttgaactgattgaaagccattcaaccaaagaagagttcatgacggactaccgcctttatatcgaactcttacgcaatctagcagatgaagcaggtttgccgaaaacgcttgatacagggagtttagctggaattaaaacgcacgagtattgcacgaataaccaaccaaacaaccactcagaccacgttgacccttatccatatcttgctaaatggggcattagccgtgagcagtttaagcatgatattgagaacggcttgacgattgaaacaggctggcagaagaatgacactggctactggtacgtacattcagacggctcttatccaaaagacaagtttgagaaaatcaatggcacttggtactactttgacagttcaggctatatgcttgcagaccgctggaggaagcacacagacggcaactggtactggttcgacaactcaggcgaaatggctacaggctggaagaaaatcgctgataagtggtactatttcaacgaagaaggtgccatgaagacaggctgggtcaagtacaaggacacttggtactacttagacgctaaagaaggcgccatggtatcaaatgcctttatccagtcagcggacggaacaggctggtactacctcaaaccagacggaacactggcagacaagccagaattcacagtagagccagatggcttgattacagtaaaa

SEQ ID NO: 78 - DNA, 1401 bp, Streptococcus pneumoniae
atgaaaaaaaaatattggactttagcgatattattcttttgtttgttcaataattctgttactgctcaagaaatacctaaaaatcttgatggcaatataactcacactcagactagcgaaagtttttctgaatctgatgaaaaacaggttgactattctaataaaaatcaagaagaagtagaccaaaataaatttcgtattcaaatcgataagacagaattatttgtaacaacagataaacatttagaaaaaaactgttgtaaattggaacttgaaccacaaataaataacgatattgttaactctgaaagtaataatttactaggcgaagataatttagataataaaattaaggaaaatgtttctcatctagataatagaggaggaaatatagagcatgacaaagataacttagaatcgtcgattgtaagaaaatatgaatgggatatagataaagttactggtggaggcgaaagttataaattatattctaaaagtaattctaaagtttcaattgctattttagattcaggagtcgatttacaaaatactggattactgaaaaatctttcaaatcactcaaaaaactatgtccccaataaaggatatttaggaaaagaggagggagaggaaggaataatatcagatattcaagatagattaggtcatggtacggctgttgtagctcaaattgtaggggatgacaatattaatggagtaaatcctcacgttaatattaacgtctatagaatatttggtaagtcgtcagctagtccagattggattgtaaaagcaatttttgatgctgtagatgatggcaatgatattatcaatcttagtactggacaatatttaatgattgatggagaatatgaggacggaacaaatgattttgaaacatttttgaagtataaaaaggctattgattacgcgaatcaaaaaggagtaattatagtagctgcattagggaatgactccctaaatgtatcaaatcagtcagatttattgaaacttattagttcacgcaaaaaagtaagaaaaccaggattagtagttgatgttccaagttatttctcatctacaatttcggtcggaggcatagatcgcttaggtaatttatcagattttagcaataaaggggattctgatgcaatatatgcgcctgcaggctcaacattatctctttcagaattaggacttaataactttattaatgcagaaaaatataaagaagattggattttttcggcaacactaggaggatatacgtatctttatggaaactcatttgctgctcctaaagtttctggtgcgattgcaatgattattgataaatacaaattaaaagatcagccctataattatatgtttgtaaaaaaattctggaagaaacattaccag

SEQ ID NO: 79 - DNA, 924 bp, Streptococcus pneumoniae
atgaaaaaagatgagttatttgaaggcttttacctaatcaaatcagctgacctgaggcaaactcgagctgggaaaaactacctagcctttaccttccaagatgatagtggcgagattgatgggaagctctgggatgcccaacctcataacattgaggcctttaccgcaggtaaggttgtccacatgaaaggacgccgagaagtttataacaatacccctcaagtcaatcaaattactctccgcctgcctcaagctggtgaacccaatgacccagctgatttcaaggtcaagtcaccagttgatgtcaaggaaattcgtgactacatgtcgcaaatgattttcaaaattgaaaatcctgtctggcaacggattgtccgaaatctctacaccaagtatgataaggaattctactcctatccagctgccaagaccaaccaccatgcctttgaaacgggcttggcctatcatacggcgaccatggtgcgtttggcagacgctattagcgaagtttatcctcagctcaataagagcctgctctatgcggggattatgttgcatgacttagctaaggtcatcgagttgacggggccagaccagacagagtacacagtgcgaggtaatcttcttggacatatcgctctcattgatagcgaaattaccaagacagttatggaactcggcatcgatgataccaaggaagaagtcgttttgcttcgtcatgtcatcctcagtcaccacggcttgcttgagtatggaagcccagtccgtccacgcattatggaagcagagattatccatatgattgacaatctggatgcaagcatgatgatgatgtcaacagctcttgctttggtggataaaggagagatgaccaataaaatcttcgctatggataatcgttccttctataaaccagatttagat

SEQ ID NO: 80 - DNA, 663 bp, Streptococcus pneumoniae
gtgacgattctaggaaaagatacagttcaacaatctgcgaaaggtgaatctgtaactcaagaagctacaccagagtataagctagaaaatacaccaggtggagataagggaggcaatactggaagctcagatgctaatgcgaatgaaggcggtggtagccaggcgggtggatcagctcacacaggttcacaaaactcagctcaatcacaagcttctaagcaattagctactgaaaaagaatcagctaaaaatgccattgaaaaagcagccaaggacaagcaggatgaaatcaaaggcgcaccgctttctgataaagaaaaagcagaacttttagcaagagtggaagcagaaaaacaagcagctctcaaagagattgaaaatgcgaaaactatggaagatgtgaaggaagcagaaacgattggagtgcaagccattgccatggttacagttcctaagagaccagtggctcctaatgctgctcctaagacaacaagtgcaccgcaagcaactgcaggaacaatgcaagatgttacctaccagtcacctgctggcaaacaattacctaacacaggttcagcatcaagtgcagcacttgctagtcttggtctagtggtggcaacaagtggttttgctttgctaggaagaaagactagacgtagaaaa

SEQ ID NO: 81 - DNA, 1008 bp, Streptococcus pneumoniae
atgaatgcagatgatacagtaaccatttatgatgtcgctcgtgaagcaggtgtttccatggcgacggtcagccgtgtggtcaatggcaataaaaatgtaaaagagaatacccgtaaaaaagtgctagaggtaattgatcgtttggattatcgtccaaatgcagttgcgcgtggtcttgcaagtaaaaagacaaccactgtcggtgtcgtgattccaaatattaccaatggttatttttcgagtttggctaaggggattgatgatattgcagaaatgtacaagtacaatattgtcctagctaatagcgatgaagataacgagaaagaagtttctgttgtcaataccctcttttcaaagcaggtagatggcattatctatatggggtatcacttgacagataaaattcgctcagaattttcgcgttcacgtactccgattgttctcgcaggaactgtcgatgttgagcaccagttgccaagtgtcaatattgactataagcaagcaacaattgatgcagtgagttaccttgctaaagaaaatgagcgtattgctttcgttagcggtccgctagtggatgacatcaatggtaaggttcgtttagttggctacaaggaaaccttgaaaaaagcaggaatcacttatagtgagggtttggtatttgaatctaaatatagctatgatgatggttacgccttagcagagcgtttgatttcatcaaatgcaactgcagcagttgtgacaggtgatgagttggcagcaggagtcttgaacggtttggctgataagggtgtttctgtgccagaagattttgaaattattactagtgatgattcacaaatctcacgctttacccgtccaaacttgacaacgattgcccaacctctttatgaccttggtgccattagtatgcgtatgttgaccaagattatgcataaggaagagttggaagaacgtgaagttctcttacctcatggtttgacagaacgtagctcaacacgaaaacgtaaa

SEQ ID NO: 82 - DNA, 1407 bp, Streptococcus pneumoniae
atgaaaaaaaagttagtatttcctaatctgttttggtggggagctgcttctagcggacctcagacagaaggtcaatatggaaaagtacatgaaaatgtgatggactactggttcaaaacgcatccagaagattttttcgataatgtcggacctcttgtagccagtaacttttttcatacttacaccgaagatttccacttgatgaaggaaattggagttaattctttccgcacttccatccaatggagtcgactcatcaagaatttagagacaggtgagcctgatccaaaaggtattgctttctacaatgccatcattgaagaagctaaaaagaaccagatggatcttgtgatgaatttacatcattttgatttaccagtggaacttcttcaaaaatacggtggttgggaaagcaaacatgtagtggagttattcgtgaagtttgccaagactgctttcacatgctttggagataaggttcattactggacaactttcaatgagccaatggtcattccagaagcaggatacttatatgctttccattatccaaatctaaaaggaaagggaaaagaggccgtacaagtcatctataatctaaaccttgctagtgcaaaagtgattcaactatatcgctcattagaacttgatggaaagattgggattattttaaacttgacacctgcttatccaagaagtaattctccagaagacttagaagcaagtcgatttacagatgacttctttaacaaagtcttcttgaatccagctgttaaaggaactttcccagaaagattggtaaaacagctagagagagatggcgtgttatggagtcataccgaaaaagagcttcaactgatgaaatcaaatacggttgattttcttggagtaaactactaccatccaaaacgtgttcaagcacaagcaaatcctgaggaatatcagacgccctggatgccagaccaatacttcaaagagtatgaatggctggagcgtcgcatgaatccatatcgtggttgggaaatttttccgaaagccatttatgatattgctatgattgtgaaggaagaatatggtaatatcccatggtttatcagtgaaaacggaatgggtgttgaaaacgaagcacggtttatcgatgaaaatggagttatcgatgacgtgtatcgtattgaattttatgaagaacatttaagatggctacataaagccattgaagagggaagtcactgttttggataccacgcttggaccgcatttgattgctggtcttggaataatgcatataagaatcgttacggatttatctccgttgatttagaaacgcaaaagagaaccatcaagagctcaggaagatggtatcgcaaagtaagtgacaataacggttttgaagtagaaattgaggag

SEQ ID NO: 83 - DNA, 408 bp, Streptococcus pneumoniae
gtggaaaatcttacgaatttttacgaaaagtatcgtgtctatctgactcgtccacgtttagagcttttggcagtagttaccattgttttctgtgctgtactcgtcttttttctaaatattccaggaaaaggtgtcttaaaactcgataatggaacgattgtttatgatggcagtcttgtccgcggtaaaatgaatggccaaggtaccattaccttccaaaatggagaccaatatacaggtggcttcaacaatggagccttcaacggaaaaggtacctttcaatctaaagaaggctggacctacgaaggtgattttgtaaatggtcaggctgaaggaaaagggaaactaacaacagaacaagaagtcgtttatgaaggaacttttaaacaaggcgtttttcaacaaaaa

SEQ ID NO: 84 - DNA, 621 bp, Streptococcus pneumoniae
atgttgaataagataagagactatttagactttgctggtttgcagtaccgtaatcctgataaagcgggagcagagcgagagaagatgctggcattccgccacaaaggacaagaggcccgaaaggtttttacagaactggccaaagcctttcaagcaagccatccagaatggcaactccaacagactagccagtggatgaatcaggcccagcgtttgagaccacatttttgggtttatctacagagagacggacaagtgacagaacctatgatggccttacgtttgtatgggacatctactgactttggaatttctttggaagtcagtttcatcgaacgtaagaaggatgagcaaacactgggcaagcaggccaaagttttagacattccaaccgttaaagggatttattatctaacctactctaatggtcaaagtcaacggtgggaggcgaatgaagaaaagcgtcgtactttacgcgagaaggtgagaagtcaagaagttcgaaaagttttagtgaaggtagatgttcctatgacagaaaattcgtctgaagaagaaatcgtagaaggcttattgaagtcttattctaaaattcttccctattatctagctacgagaaaa

SEQ ID NO: 85 - DNA, 459 bp, Streptococcus pneumoniae
atggttcagaacagttgttggcaatcaaagagccataaggtcaaggcttttaccttgttagaatccctgcttgccctcattgtcatcagtgggggattactcctttttcaagctatgagtcagctcctcatttcagaagttcgctaccagcaacaaagcgagcaaaaggagtggctcttgtttgtggaccaacttgaggtagaattagaccgttcgcagttcgaaaaagtagaaggcaatcgcctatacatgaagcaagatggcaaggacatcgccatcggtaagtcaaagtcagatgatttccgtaaaacgaatgctcgtggtcgaggttatcagcctatggtttatggactcaaatctgtacggattacagaggacaatcaactggttcgctttcatttccagttccaaaaaggcttagaaagggagttcatctatcgtgtggaaaaagaaaaaagt

SEQ ID NO: 86 - DNA, 324 bp, Streptococcus pneumoniae
atgaaaaaaatgatgacattcttgaaaaaagctaaggttaaagcttttacattggtggagatgttggtggtcttgctgattatcagcgtgcttttcttgctctttgtacctaatctgaccaagcaaaaagaagcagtcaatgacaaaggaaaagcagctgttgttaaggtggtggaaagccaggcagaactttatagcttagaaaagaatgaagatgctagcctaagaaagttacaagcagatggacgcatcacggaagaacaggctaaagcttataaagaatacaatgataaaaatggaggagcaaatcgtaaagtcaatgat

SEQ ID NO: 87 - DNA, 897 bp, Streptococcus pneumoniae
atgacatcaaaagttagaaaggcagtcatccctgctgctggactaggaactcgatttttaccagcaaccaaggcccttgccaaagaaatgttgccaatcgtagacaaaccaactatccagtttatcgtggaagaagctctcaaatcaggtattgaagatattctagttgtcactggtaaatcaaaacgttctattgaggaccactttgattcaaacttcgaattggaatataacctcaaagaaaaagggaaaacagatcttttgaagctagttgataaaacaactgacatgcgtctgcattttatccgccaaactcatccacgcggtctcggagatgctgttttgcaagccaaggctttcgtcggaaatgaaccttttgtcgttatgcttggtgatgacttgatggatatcacagacgaaaaggctgttccacttaccaaacaactcatggatgactacgagcgtacccacgcgtctactatcgctgtcatgccagtccctcatgacgaagtatctgcttacggggttattgctccgcaaggcgaaggaaaagatggtctttacagtgttgaaacctttgttgaaaaaccagctccagaggacgctcctagcgaccttgctattatcggacgctacctcctcacgcctgaaatttttgagattctcgaaaagcaagctccaggtgcaggaaatgaaattcagctgacagatgcaatcgacaccctcaataaaacacaacgtgtatttgctcgtgagttcaaaggggctcgttacgatgtcggagacaagtttggcttcatgaaaacatccatcgactacgccctcaaacacccacaagtcaaagatgatttgaagaattacctcatccaacttggaaaagaattgactgagaaggaa

SEQ ID NO: 88 - DNA, 2463 bp, Streptococcus pneumoniae
atgcaaaatcaattaaatgaattaaaacgaaaaatgctggaatttttccagcaaaaacaaaaaaataaaaaatcagctagacctggcaagaaaggttcaagtaccaaaaaatctaaaaccttagataagtcagtcattttcccagctattttactgagtataaaagccttatttaacttactctttgtactcggttttctaggaggaatgttgggagctgggattgctttgggatacggagtggccttatttgacaaggttcgggtgcctcagacagaagaattggtgaatcaggtcaaggacatctcttctatttcagagattacctattcggacgggacggtgattgcttccatagagagtgatttgttgcgcacttctatctcatctgagcaaatttcggaaaatctgaagaaggctatcattgcgacagaagatgaacactttaaagaacataagggtgtagtacccaaggcggtgattcgtgcgaccttggggaaatttgtaggtttgggttcctctagtgggggttcaaccttgacccagcaactaattaaacagcaggtggttggggatgcgccgaccttggctcgtaaggcggcagagattgtggatgctcttgccttggaacgcgccatgaataaagatgagattttaacgacctatctcaatgtggctccctttggccgaaataataagggacagaatattgcaggggctcggcaagcagctgagggaattttcggtgtagatgccagtcagttgactgttcctcaagcagcatttttagcaggacttccacagagtcccattacttactctccttatgaaaatactggggagttgaagagtgatgaagacctagaaattggcttaagacgggctaaggcagttctttacagtatgtatcgtacaggtgcattaagcaaagacgagtattctcagtacaaggattatgaccttaaacaggactttttaccatcgggcacggttacaggaatttcacgagactatttatactttacaactttggcagaagctcaagaacgtatgtatgactatctagctcagagagacaatgtctccgctaaggagttgaaaaatgaggcaactcagaagttttatcgagatttggcagccaaggaaattgaaaatggtggttataagattactactaccatagatcagaaaattcattctgccatgcaaagtgcggttgctgattatggctatcttttagacgatggaacaggtcgtgtagaagtagggaatgtcttgatggataaccaaacaggtgctattctaggctttgtaggtggtcgtaattatcaagaaaatcaaaataatcatgcctttgataccaaacgttcgccagcttctactaccaagcccttgctggcctacggtattgctattgaccagggcttgatgggaagtgaaacgattctatctaactatccaacaaactttgctaatggcaatccgattatgtatgctaatagcaagggaacaggaatgatgaccttgggagaagctctgaactattcatggaatatccctgcttactggacctatcgtatgctccgtgaaaagggtgttgatgtcaagggttatatggaaaagatgggttacgagattcctgagtacggtattgagagcttgccaatgggtggtggtattgaagtcacagttgcccagcataccaatggctatcagaccttagctaataatggagtttatcatcagaagcatgtgatttcaaagattgaagcagcagatggtagagtggtgtatgagtatcaggataaaccggttcaagtctattcaaaagctactgcgacgattatgcagggattgctacgagaagttctatcctctcgtgtgacaacaaccttcaagtctaacctgacttctttaaatcctactctggctaatgcagattggattgggaagactggtacaaccaaccaagacgaaaatatgtggctcatgctttcgacacctagattaaccctaggtggctggattgggcatgatgataatcattcattgtcacgtagagcaggttattctaataactctaattacatggctcatctggtaaatgcgattcagcaagcttccccaagcatttgggggaacgagcgctttgctttagatcctagtgtagtgaaatcggaagtcttgaaatcaacaggtcaaaaaccagagaaggtttctgttgaaggaaaagaagtagaggtcacaggttcgactgttaccagctattgggctaataagtcaggagcgccagcgacaagttatcgctttgctattggcggaagtgatgcggattatcagaatgcttggtctagtattgtggggagtctaccaactccatccagctccagcagttcaagtagtagttctagcgatagcagtaactcaagtactacacgaccttcttcttcaagggcgagacga

SEQ ID NO: 89 - DNA, 1269 bp, Streptococcus pneumoniae
atgtcatctaaatttatgaagagcgctgcggtgcttggaactgctacacttgctagcttgcttttggtagcttgcggaagcaaaactgctgataagcctgctgattctggttcatctgaagtcaaagaactcactgtatatgtagacgagggatataagagctatattgaagaggttgctaaagcttatgaaaaagaagctggagtaaaagtcactcttaaaactggtgatgctctaggaggtcttgataaactttctcttgacaaccaatctggtaatgtccctgatgttatgatggctccatacgaccgtgtaggtagccttggttctgacggacaactttcagaagtgaaattgagcgatggtgctaaaacagacgacacaactaaatctcttgtaacagctgctaatggtaaagtttacggtgctcctgccgttatcgagtcacttgttatgtactacaacaaagacttggtgaaagatgctccaaaaacatttgctgacttggaaaaccttgctaaagatagcaaatacgcattcgctggtgaagatggtaaaactactgccttcctagctgactggacaaacttctactatacatatggacttcttgccggtaacggtgcttacgtctttggccaaaacggtaaagacgctaaagacatcggtcttgcaaacgacggttctatcgtaggtatcaactacgctaaatcttggtacgaaaaatggcctaaaggtatgcaagatacagaaggtgctggaaacttaatccaaactcaattccaagaaggtaaaacagctgctatcatcgacggaccttggaaagctcaagcctttaaagatgctaaagtaaactacggagttgcaactatcccaactcttccaaatggaaaagaatatgctgcattcggtggtggtaaagcttgggtcattcctcaagccgttaagaaccttgaagcttctcaaaaatttgtagacttccttgttgcaactgaacaacaaaaagtattatatgataagactaacgaaatcccagctaatactgaggctcgttcatacgctgaaggtaaaaacgatgagttgacaacagctgttatcaaacagttcaagaacactcaaccactgccaaacatctctcaaatgtctgcagtttgggatccagcgaaaaatatgctctttgatgctgtaagtggtcaaaaagatgctaaaacagctgctaacgatgctgtaacattgatcaaagaaacaatcaaacaaaaatttggtgaa

SEQ ID NO: 90 - DNA, 465 bp, Streptococcus pneumoniae
atgatagataaagtggtcaggaacctactcctgacctttttcttttgcaaaatgacaaaaatcataatttttttgacaactatacttgtcaaaaagaaaaagatatgttacaatgaattcaagttaagaaataggaagcagaaaggagttataatgtgggtactaggatttatactatttatgattttcttttattctaataattctaaaaaaatcaagaaactagagaataaaatcaaaagacttgagcgaaaagagaaaggaaacgcagaaatgtcgagattattacaagaaatgattggaaaggaaccaattataacgggagtgtatattgggccagataactgggaagttgtggatgttgatgaggaatgggtaaagctacgacgtgtagataatacgggaaaagaaaaattcaagttgcaacgtattgaggatatccaaaccgttgaatttgacggagag

SEQ ID NO: 91 - DNA, 855 bp, Streptococcus pneumoniae
atgattttaagtaaaaatagagaagatgggttaagaaaatttgcgactaacatccgattaaatactcttagaacattgaatcatcttggattcggacattacggaggaagtctgtctatcgtagaagttttagcggtgctttatggtgaaataatgccaatgactccagaaatatttgcagcacgagatagagattatttcatattatcaaaaggtcacggaggaccagctctatacagtacactctatttgaatggtttctttgacaaagaattcttatattctttaaatacaaatggaaccaaattaccgtctcatcctgatagaaatctaacgccaggcatagatatgacaacgggctctttaggacaaggaattagtgttgcaactggacttgcatatggtcagagaataagaaagagtcccttttatacttacgctattgttggagatggtgagttaaatgagggacaatgttgggaggctatacagtttgcttctcatcaacagttatccaacttaattgtatttgttgatgataacaaaaaacaattagatggttttacaaaggatatttgtaatccaggtgatttcgtagaaaaattttcagcatttggatttgaatccattagggtcaagggttcagatattagagaaatttatgaagggattgtccaattaaaacagtcaaataattcatcacctaagtgcattgtattagatactattaaaggtcaaggggttcaagagctggaagaaatgaaatccaatcatcatcttcgccctactgtagaggagaaacaaatgttaacttcagttgtagaaagattaagtcaggaattggaggaaacagaa

SEQ ID NO: 92 - DNA, 1863 bp, Streptococcus pneumoniae
atgaaaaaaactacaatattatcattaactacagctgcggttattttagcagcatatgtccctaatgaaccaatcctagcagatactcctagttcggaagtaatcaaagagactaaagttggaagtattattcaacaaaataatatcaaatataaggttctaactgtagaaggtaacataggaactgttcaagtgggtaatggagttactcctgtagagtttgaagctggtcaagatggaaaaccattcacgattcctacaaaaatcacagtaggtgataaagtatttaccgttactgaagtagctagtcaagcttttagttattatccagatgaaacaggtagaattgtctactatcctagctctattactatcccatcaagcataaaaaaaatacaaaaaaaaggcttccatggaagtaaagctaaaactattatttttgacaaaggcagtcagctggagaaaattgaagatagagcttttgatttttctgaattagaagagattgaattgcctgcatctctagaatatattggaacaagtgcattttcttttagtcaaaaattgaaaaagctaaccttttcctcaagttcaaaattagaattaatatcacatgaggcttttgctaatttatcaaatttagagaaactaacattaccaaaatcggttaaaacattaggaagtaatctatttagactcactactagcttaaaacatgttgatgttgaagaaggaaatgaatcgtttgcctcagttgatggtgttttgttttcaaaagataaaacccaattaatttattatccaagtcaaaaaaatgacgaaagttataaaacgcctaaggagacaaaagaacttgcatcatattcgtttaataaaaattcttacttgaaaaaactcgaattgaatgaaggtttagaaaaaatcggtacttttgcatttgcagatgcgattaaacttgaagaaattagcttaccaaatagtttagaaactattgaacgtttagccttttacggtaatttagaattaaaagaacttatattaccagataatgttaaaaattttggtaaacacgttatgaacggtttaccaaaattaaaaagtttaacaattggtaataatatcaactcattgccgtccttcttcctaagtggcgtcttagattcattaaaggaaattcatattaagaataaaagtacagagttttctgtgaaaaaagatacatttgcaattcctgaaactgttaagttctatgtaacatcagaacatataaaagatgttcttaaatcaaatttatctactagtaatgatatcattgttgaaaaagtagataatataaaacaagaaactgatgtagctaaacctaaaaagaattctaatcagggagtagttggttgggttaaagacaaaggtttatggtattacttaaacgaatcaggttcaatggctactggttgggttaaagacaaaggtttatggtattacttaaacgaatcaggttcaatggctactggttgggttaaagacaaaggcttatggtactacttaaatgaatcaggttcaatggctactggttgggttaaagacaaaggcttatggtattacttaaacgaatcaggttcaatggctactggttgggttaaagacaaaggcttatggtactacttaaatgaatcaggttcaatggctactggttgggttaaagacaaaggcttatggtattacttaaatgaatcaggttcaatggctactggttgggttacagtttctggtaaatggtactatacctataattcaggagatttattagtaaacacgactacacccgatggctatcgagtcaatgctaacggtgagtgggtagga

SEQ ID NO: 93 - DNA, 1878 bp, Streptococcus pneumoniae
atggtaagatttacaggacttagtctcaaacaaacgcaagctattgaggttttaaaaggtcacatttctctaccagatgtggaagtggctgtcactcagtctgaccaagcatctatctctatcgagggtgaggaaggtcactatcaattgacctaccgcaaacctcaccaactttatcgtgccttgtccttgttggtaacagttctagcagaagctgataaagtagagattgaggaacaagcagcttacgaagatttggcttacatggttgactgttctcgaaatgcggtgctgaatgtggcttctgccaagcagatgattgagatattggctctcatgggctactcaacctttgagctttacatggaagacacttaccagattgaagggcagccttactttggctatttccgtggagcttattcagcagaggagttgcaggaaatcgaagcctatgcccaacagtttgacgtgacctttgtaccatgcatccagaccttggcccacttgtcggcctttgtcaaatggggtgtcaaggaagtgcaggagctccgtgatgtagaggacattcttctcattggcgaagaaaaggtttatgacttgattgatggcatgtttgccacgttgtctaaactgaagactcgcaaggtcaatatcgggatggacgaagcccacttggttggtttgggacgctacctgattctgaacggtgttgtggatcgtagtctcctcatgtgccaacacttggagcgcgtgctggatattgctgacaaatatggtttccactgccagatgtggagtgatatgttcttcaaactcatgtcagcggatggccagtacgaccgtgatgtggaaattccagaggaaactcgtgtctacctagaccgtctcaaagaccgtgtgactctggtttactgggattattatcaggatagcgaggaaaaatacaaccgtaatttccgcaatcatcacaagattagccatgaccttgcatttgcagggggagcttggaagtggattggctttacacctcacaaccattttagccgtctagtggctatcgaggctaataaagcctgccgtgccaatcagattaaagaagtcatcgtaacgggttggggagacaatggtggtgaaactgcccagttctctatcctaccaagcttgcaaatctgggcagaactcagctatcgcaatgacctagatggtttgtctgcgcacttcaagaccaatactggtctaacggttgaggattttatgcagattgaccttgccaacctcttaccagacctaccaggcaatctcagcggtatcaatcccaaccgctatgttttttatcaggatattctttgtccgattcttgatcaacacatgacacctgaacaggacaaaccgcacttcgctcaggctgctgagacgcttgctaacattaaagaaaaagctggaaactatgcctatctctttgaaactcaggcccagttgaatgctattttaagtagcaaagtagatgtgggacgacgcattcgtcaggcctaccaagcggatgataaagaaagtttacaacaaatcgccagacaagaattaccagaacttagaagccaaattgaagacttccatgccctctttagccaccaatggctgaaagaaaacaaggtctttggtttggatacagttgacatccgtatgggcggactcttgcaacgcatcaaacgagcagaaagccgtatcgaggtttatctggctggtcagcttgaccgcatcgacgagctggaagttgaaatcctaccatttactgacttctacgcagacaaggatttcgcagcaactacagccaaccagtggcataccattgcgacagcgtcgacgatttatacgact

SEQ ID NO: 94 - DNA, 831 bp, Streptococcus pneumoniae
atgtctaattcatttgtcaagttgttagtctctcaattatttgcaaatttagcagatattttctttagagtaacaatcattgctaacatatacattatttcaaaatcagtaattgccacatcactagttcctatcttaataggaatatcctcttttgttgcgagtcttttagttccgttggttactaaaaggttagcgctaaatagggttttatctttatctcaatttggaaagactatattattggcgatactggtaggaatgtttaccgtaatgcaatccgtagcgcctttggtgacctatctatttgttgttgcaatttccatactagatggttttgcagcacccgtttcctatgctattgtgccacgctatgcgaccgatttgggtaaggctaattcagccttatcaatgactggtgaagctgttcaattgataggttggggattaggtggactcttgtttgcaacaattggtctgttacctaccacgtgtatcaatttagtcttgtatatcatttctagctttctgatgttatttcttcctaacgctgaagtggaggtgttagagtcagaaactaatcttgaaattttgctcaaaggttggaagttagttgctagaaatcctagattaagactttttgtatcagcaaatttattggaaattttttcaaatacgatttgggtttcttccattatacttgtttttgtaacggagttattaaataaaacggaaagttactggggatattctaatacagcatactctattggtattataattagtggcttaattgcttttaggctatctgaaaagttccttgctgctaaa

SEQ ID NO: 95 - DNA, 2079 bp, Streptococcus pneumoniae
atgtttgcatcaaaaagcgaaagaaaagtacattattcaattcgtaaatttagtgttggagtagctagtgtagttgttgccagtcttgttatgggaagtgtggttcatgcgacagagaacgagggagctacccaagtacccacttcttctaatagggcaaatgaaagtcaggcagaacaaggagaacaacctaaaaaactcgattcagaacgagataaggcaaggaaagaggtcgaggaatatgtaaaaaaaatagtgggtgagagctatgcaaaatcaactaaaaagcgacatacaattactgtagctctagttaacgagttgaacaacattaagaacgagtatttgaataaaatagttgaatcaacctcagaaagccaactacagatactgatgatggagagtcgatcaaaagtagatgaagctgtgtctaagtttgaaaaggactcatcttcttcgtcaagttcagactcttccactaaaccggaagcttcagatacagcgaagccaaacaagccgacagaaccaggagaaaaggtagcagaagctaagaagaaggttgaagaagctgagaaaaaagccaaggatcaaaaagaagaagatcgtcgtaactacccaaccattacttacaaaacgcttgaacttgaaattgctgagtccgatgtggaagttaaaaaagcggagcttgaactagtaaaagtgaaagctaacgaacctcgagacgagcaaaaaattaagcaagcagaagcggaagttgagagtaaacaagctgaggctacaaggttaaaaaaaatcaagacagatcgtgaagaagcagaagaagaagctaaacgaagagcagatgctaaagagcaaggtaaaccaaaggggcgggcaaaacgaggagttcctggagagctagcaacacctgataaaaaagaaaatgatgcgaagtcttcagattctagcgtaggtgaagaaactcttccaagcccatccctgaaaccagaaaaaaaggtagcagaagctgagaagaaggttgaagaagctaagaaaaaagccgaggatcaaaaagaagaagatcgccgtaactacccaaccaatacttacaaaacgcttgaacttgaaattgctgagtccgatgtggaagttaaaaaagcggagcttgaactagtaaaagaggaagctaaggaacctcgaaacgaggaaaaagttaagcaagcaaaagcggaagttgagagtaaaaaagctgaggctacaaggttagaaaaaatcaagacagatcgtaaaaaagcagaagaagaagctaaacgaaaagcagcagaagaagataaagttaaagaaaaaccagctgaacaaccacaaccagcgccggctccaaaagcagaaaaaccagctccagctccaaaaccagagaatccagctgaacaaccaaaagcagaaaaaccagctgatcaacaagctgaagaagactatgctcgtagatcagaagaagaatataatcgcttgactcaacagcaaccgccaaaaactgaaaaaccagcacaaccatctactccaaaaacaggctggaaacaagaaaacggtatgtggtacttctacaatactgatggttcaatggcgacaggatggctccaaaacaatggctcatggtactacctcaacagcaatggcgctatggcgacaggatggctccaaaacaatggttcatggtactatctaaacgctaatggttcaatggcaacaggatggctccaaaacaatggttcatggtactacctaaacgctaatggttcaatggcgacaggatggctccaatacaatggctcatggtactacctaaacgctaatggttcaatggcgacaggatggctccaatacaatggctcatggtactacctaaacgctaatggtgatatggcgacaggttgggtgaaagatggagatacctggtactatcttgaagcatcaggtgctatgaaagcaagccaatggttcaaagtatcagataaatggtactatgtcaatggctcaggtgcccttgcagtcaacacaactgtagatggctatggagtcaatgccaatggtgaatgggtaaac

SEQ ID NO: 96 - DNA, 2430 bp, Streptococcus pneumoniae
atgaactattcaaaagcattgaatgaatgtatcgaaagtgcctacatggttgctggacattttggagctcgttatctagagtcgtggcacttgttgattgccatgtctaatcacagttatagtgtagcaggggcaactttaaatgattatccgtatgagatggaccgtttagaagaggtggctttggaactgactgaaacggactatagccaggatgaaacctttacggaattgccgttctcccgtcgtttgcaggttctttttgatgaagcagagtatgtagcgtcagtggtccatgctaaggtactagggacagagcacgtcctctatgcgattttgcatgatagcaatgccttggcgactcgtatcttggagagggctggtttttcttatgaagacaagaaagatcaggtcaagattgctgctcttcgtcgaaatttagaagaacgggcaggctggactcgtgaagatctcaaggctttacgccaacgccatcgtacagtagctgacaagcaaaattctatggccaatatgatgggcatgccgcagactcctagtggtggtctcgaggattatacgcatgatttgacagagcaagcgcgttctggcaagttagaaccagtcatcggtcgggacaaggaaatctcacgtatgattcaaatcttgagccggaagactaagaacaaccctgtcttggttggggatgctggtgtcgggaaaacagctctggcgcttggtcttgcccagcgtattgctagtggtgacgtgcctgcggaaatggctaagatgcgcgtgttagaacttgatttgatgaatgtcgttgcagggacacgcttccgtggtgactttgaagaacgcatgaataatatcatcaaggatattgaagaagatggccaagtcatcctctttatcgatgaactccacaccatcatgggttctggtagcgggattgattcgactctggatgcggccaatatcttgaaaccagccttggcgcgtggaactttgagaacggttggtgccactactcaggaagaatatcaaaaacatatcgaaaaagatgcggcactttctcgtcgtttcgctaaagtgacgattgaagaaccaagtgtggcagatagtatgactattttacaaggtttgaaggcgacttatgagaaacatcaccgtgtacaaatcacagatgaagcggttgaaacagcggttaagatggctcatcgttatttaaccagtcgtcacttgccagactctgctatcgatctcttggatgaggcggcagcaacagtgcaaaataaggcaaagcatgtaaaagcagacgattcagatttgagtccagctgacaaggccctgatggatggcaagtggaaacaggcagcccagctaatcgcaaaagaagaggaagtacctgtctacaaagacttggtgacagagtctgatattttgaccaccttgagtcgcttgtcaggaatcccagttcaaaaactgactcaaacggatgctaagaagtatttaaatcttgaagcagaactccataaacgggttatcggtcaagatcaagctgtttcaagcattagccgtgccattcgccgcaaccagtcagggattcgcagtcataagcgtccgattggttcctttatgttcctagggcctacaggtgtcgggaaaactgaattagccaaggctctggcagaagttctttttgacgacgaatcagcccttatccgctttgatatgagtgagtatatggagaaatttgcagctagtcgtctcaacggagctcctccaggctatgtaggatatgaagaaggtggggagttgacagagaaggttcgcaataaaccctattccgttctcctctttgatgaggtagagaaggcccacccagatatctttaatgttctcttgcaggttctggatgacggtgtcttgacagatagcaagggacgcaaggtcgatttttcaaataccattatcattatgacatcgaatctaggtgcgactgcccttcgtgatgataagactgttggttttggggctaaggatattcgttttgaccaggaaaatatggaaaaacgcatgtttgaagaactgaaaaaagcttatagaccggaattcatcaaccgtattgatgagaaggtggtcttccatagcctatctagtgatcatatgcaggaagtggtgaagattatggtcaagcctttagtggcaagtttgactgaaaaaggcattgacttgaaattacaagcttcagctctgaaattgttagcaaatcaaggatatgacccagagatgggagctcgcccacttcgcagaaccctgcaaacagaagtggaggacaagttggcagaacttcttctcaagggagatttagtggcaggcagcacacttaagattggtgtcaaagcaggccagttaaaatttgatattgca

SEQ ID NO: 97 - DNA, 1344 bp, Streptococcus pneumoniae
atgaaaattttaccgtttatagcaagaggaacaagttattacttgaagatgtcagttaaaaagcttgttccttttttagtagtaggattgatgctagcagctggtgatagtgtctatgcctattccagaggaaatggatcgattgcgcgtggggatgattatcctgcttattataaaaatgggagccaggagattgatcagtggcgcatgtattctcgtcagtgtacttcttttgtagcctttcgtttgagtaatgtcaatggttttgaaattccggcagcttatggaaatgcgaatgaatggggacatcgtgctcgtcgggaaggttatcgtgtagataatacaccgacgattggttccattacttggtctactgcaggaacttatggtcatgttgcctgggtgtcaaatgtaatgggagatcagattgagattgaggaatataactatggttatacagaatcctataataaacgagttataaaagcaaacacgatgacaggatttattcattttaaagatttggatggtggcagtgttgggaatagtcaatcctcaacttcaacaggcggaactcattattttaagaccaagtctgctattaaaactgaacctctagctagcggaactgtgattgattactattatcctggggagaaggttcattatgatcagatacttgaaaaagacggctataagtggttgagttatactgcctataatggaagctatcgttatgttcaattggaggctgtgaataaaaatcctctaggtaattctgttctttcttcaacaggtggaactcattattttaagaccaagtctgctatcaaaactgaacccctagttagtgcaactgtgattgattactattatcctggagagaaggttcattatgatcaaattctcgaaaaagacggctacaagtggttgagttatacggcttataacggaagtcgtcgctatatacagctagagggagtgacttcttcacaaaattatcagaatcaatcaggaaacatctctagctatggatcccatagtagttcaactgtcggttggaagaaaataaatggtagttggtatcatttcaaatcaaatggttctaaatcaacaggatggctgaaagacggttctagctggtattatttgaaattatctggtgaaatgcagacaggatggttaaaggaaaatggtttgtggtattatctgggtagttcaggggcaatgaaaacaggctggtaccaggtctctggtaagtggtattattcttactcttcaggcgccttagctgttaatacgacggtggatggctacagagtaaacagtgatggagaacgagta

SEQ ID NO: 98 - DNA, 450 bp, Streptococcus pneumoniae
atgaaagtaatctttttagcagatgttaaaggaaaaggtaaaaaaggcgaaattaaggaagtaccaacagggtatgcgcaaaactttcttatcaaaaagaatctagccaaagaagcgactgctcaagctgtaggtgaacttcgtggtaaacaaaaatcggaagaaaaagctcacgctgagatgattgcagaaggaaaagcaattaaagcacaacttgaagcagaagaaactgttgtagaatttgttgaaaaagttggtccagatggtcgtacctttggttctattaccaataagaagattgcagaagaattgcaaaagcaatttggaattaagattgataaacgtcatattcaagtacaagctccgattcgagcggttggtttgattgatgtgccagtgaaaatctatcaagatatcacaagtgtaatcaatcttcgtgtgaaagaagga

SEQ ID NO: 99 - DNA, 1176 bp, Streptococcus pneumoniae
atgaagaaaaaaatcttagcgtcacttttattaagtacagtaatggtttctcaagtagctgttttaacaactgcgcatgcagaaacgactgatgacaaaattgctgctcaagataataaaattagtaacttaacagcacaacaacaagaagcccaaaaacaagttgaccaaattcaggagcaagtatcagctattcaagctgagcagtctaacttgcaagctgaaaatgatagattacaagcagaatctaagaaactcgagggtgagattacagaactttctaaaaacattgtttctcgtaaccaatcgttggaaaaacaagctcgtagtgctcaaacaaatggagccgtaactagctatatcaataccattgtaaactcaaaatcaattacagaagctatttcacgtgttgctgcaatgagtgaaatcgtatctgcaaacaacaaaatgttagaacaacaaaaggcagataaaaaagctatttctgaaaaacaagtagcaaataatgatgctatcaatactgtaattgctaatcaacaaaaattggctgatgatgctcaagcattgactacgaaacaggcagaactaaaagctgctgaattaagtcttgctgctgagaaagcgacagctgaaggggaaaaagcaagtctattagagcaaaaagcagcagctgaggcagaggctcgtgcagctgcggtagcagaagcagcttataaagaaaaacgagctagccaacaacaatcagtacttgcttcagcaaacactaacttaacagctcaagtgcaagcagtatctgaatctgcagcagcacctgtccgtgcaaaagttcgtccaacatacagtacaaacgcttcaagttatccaattggagaatgtacatggggagtaaaaacattggcaccttgggctggagactactggggtaatggagcacagtgggctacaagtgcagcagcagcaggtttccgtacaggttcaacacctcaagttggagcaattgcatgttggaatgatggtggatatggtcacgtagcggttgttacagctgttgaatcaacaacacgtatccaagtatcagaatcaaattatgcaggtaatcgtacaattggaaatcaccgtggatggttcaatccaacaacaacttctgaaggttttgttacatatatttatgcagat

SEQ ID NO: 100 - DNA, 387 bp, Streptococcus pneumoniae
atggtaaaaagacgtataaggagagggacgagagaacctgaaaaagttgttgttcctgagcaatcatctattccttcgtatcctgtatctgttacatctaaccaaggaacagatgtagcagtagaaccagctaaagcagttgctccaacaacagactggaaacaagaaaatggtatgtggtatttttataatactgatggttccatggcaacaggttgggtacaagttaatagttcatggtactacctcaacagcaacggttctatgaaagtcaatcaatggttccaagttggtggtaaatggtattatgtaaatacatcgggtgagttagcggtcaatacaagtatagatggctatagagtcaatgataatggtgaatgggtgcgt

SEQ ID NO: 101 - DNA, 138 bp, Streptococcus pneumoniae
gagttgcgacggctatcaaggttggtggaccaggagctctattttggatgtggatggcggctttctttggaatggctaccaagtatgcggaaggactcttggccatcaaataccgcaccaaggacgaccatggtgcag

SEQ ID NO: 102 - DNA, 93 bp, Streptococcus pneumoniae
gactgtatcaggaaacaaccgttcacacgcgatgaaccaaacaaaacgtgccgtaaaaccaaaccttcaaaaagttactgttcttatcgatgg

SEQ ID NO: 103 - DNA, 78 bp, Streptococcus pneumoniae
ggacaaagaaaccctcgaagaattgaaagagttatcagaatggcagaaacgaaaccaagaatatctaaaaaagaaggc

SEQ ID NO: 104 - DNA, 249 bp, Streptococcus pneumoniae
cagaggaagctgttcaaaatcttccacctattccagaagaaaagtgggtggaaccagaaatcatcctgcctcaagctgaacttaaattccctgaacaggaagatgactcagatgacgaagatgttcaggtcgatttttcagccaaagaagcccttgaatacaaacttccaagcttacaactctttgcaccagataaaccaaaagatcagtctaaagagaagaaaattgtcagagaaaatatcaaaatct

SEQ ID NO: 105 - DNA, 312 bp, Streptococcus pneumoniae
ttggtgattatagttttgaaaatccagtccaaatcggagacagactttattttcaagacatggccatttattcttttgtcaaaaataatacctttaatggtattggattgccaagtctctatctcatggacgaacagggagactgtagcttactcaaagcttttggctatcaagactttaaagggagattatcatgatggacagtccaaaaaaattaggctatcacatgccagcagagtacgaaccccatcatggtaccctcatgatatggccgactcgaccaggatcatggccttttcaaggaaaggctgc

SEQ ID NO: 106 - DNA, 90 bp, Streptococcus pneumoniae
gagagactaccagcttttcctagaagtctttcagggaggaagttggaccaaggcggaaccaaagaaaaaggctcggatggaagaagtcct

SEQ ID NO: 107 - DNA, 912 bp, Streptococcus pneumoniae
agaaattgcctctctacttggaaaagctcctcaaactatcacactgaaatcaagcgtgggacagtccgacaatgtcttggaaaagggcgcttcaaagaggtttattctgccgactacgctcaacagtcttatgaaaacaatcgcaagcgctcggtcaagaaatcaagcttgaccaaggaactaaaggaaaagattctccactatcataaccaaaaattttcgcctgaaatgatggttatggctaaaggggttaacgtgggaatttcaaccatttactattggattcatcatggaaaattggggttaagcaagcaggatttgctttaccctagaaaaggaaaagcgcttaagaaacaggctagcaccaactttaaacctgctggtcaatccatcgaacagcggcctgaagctatcaatcttcgcttggagaatgggcattatgagattgatacggttctacttacgagatcgaaaaactactgcttgattgtcttgacggatcgaaagagtagacatcagatcatccgattgattccaaataaaagtgctgaggtggtcaatcaggctctaaaactcatcttaaaacaacacaagattctttccatcacggcagataatggaacggaattcaatcgcttgtttgatatattttctgaggagcacatctattatgcgcacccctatgcctcttgggaaaggggaactaatgagaatcacaacaggctcattcgtagatagttacctaagggaaccaagaaaatgactcccaaagaagtcgcattcatcgaaaagtggattaacaactatcctaaaaaatgcttggactacaagtcacccagagaagacttctggatggctaacttgaacttgaaatttagcaaaatggaaataatttttattaaacgcttccaa

SEQ ID NO: 108 - DNA, 108 bp, Streptococcus pneumoniae
cctgtcatgactatctcatcgcctactatgaaaaacatggatttgtcaacgaaggccagtcccagtcaacctttgcaggggaaacatggtatgatatggtctgggaaa

SEQ ID NO: 109 - DNA, 84 bp, Streptococcus pneumoniae
acatcatcaataaggatacacacaaggaaatcatcgccaaactggactacgacgccccatcttgccctgagtgcggaaaccaat

SEQ ID NO: 110 - DNA, 81 bp, Streptococcus pneumoniae
tacttccttccacacaagtatgccagagaaagcttatcgctaccctctaccaacaaaatattacacagaaaacaaggttcg

SEQ ID NO: 111 - DNA, 159 bp, Streptococcus pneumoniae
gcagccttcaaaaaagatcaaattaatgagcgtgtcgagaaattaggtaagttaaaacctattacaataaattacaacggaaaatcagaagtaattgatagtaaagaaaaattacaagagcttatgaataaagccgttaaagacgaagtggctcaaata

SEQ ID NO: 112 - DNA, 99 bp, Streptococcus pneumoniae
gcttatgcgcattctaaaagaagcgctggaagtggcagggcaggaggcagacaatgtctttgccaatgtcaaaataaatgtaggagagattttaagtat

SEQ ID NO: 113 - DNA, 108 bp, Streptococcus pneumoniae
cacggccgaccttatcataagcctcaccaaccgcatcatcacgggtttccccaacaatcttataatctcctgcctccgaaacataaaccaactctgtgtgtccgccgc

SEQ ID NO: 114 - DNA, 390 bp, Streptococcus pneumoniae
aaaggaaaaatcctcctgctaccaaggctaaccactcaaagatggcaaagaaaaatccgccctgactcacgtaagtcagcaaataataaagcaaaccttgacttccataatagtcgctgtaaatcttccctgtctgatgaagcgcccaacctgcataaaaatcctgcacttcttgtgcactcattaagtcgagtaatagcggtactcctagagttatccccgttacaagcgtactccatagtaaaattttcaccaaaggaagacgacttgattcacgatgatgcgattcttgttcgatttggtattctagaggttcacgattctccttatgaacttcttctactctaccatacacactcatatcgtttctcctgttcaatttatctgtct

SEQ ID NO: 115 - DNA, 432 bp, Streptococcus pneumoniae
tttacggtaagccatgtattcctcctttatttatcttttaatccaagacccaaatcaatgagtttgagtttcacttcttccaaactcttgcgtccaagatttcgtactttcatcatctctgcttcagatttttctgtcaaatcatgcacagtattgataccggcacgttttaaacagttgtatgaacgcacagacaagtccagttcctcaatcgtacgatctaaaatacggtcgtcagattcagtatcagcttctttcatcacttcagttgacttagcaatctcagtaagatttgtaaacaaatcaagatgttctgtcaaaatacgtgctgaaagccctaaagcatcttctggaataattgttccatttgtcaagatttcaagggttaatttgtcgaaaccatcattgctacctacacgagcaggttccact

SEQ ID NO: 116 - DNA, 54 bp, Streptococcus pneumoniae
cttgtctgcatgaagaataagggctgctacaaggaaagaaacaactgctgccac

SEQ ID NO: 117 - DNA, 174 bp, Streptococcus pneumoniae
ttccattatttgtcaaaatactttttagtttcagcaataacgactggcgacaagaccaagagggcaatcaagtttggcagagccatcaaggcgttaacgatatctgcgataatccagaccatatccaactcgataaatcctcctaacaagaccatgagcacaaaaaccacacgg

SEQ ID NO: 118 - DNA, 141 bp, Streptococcus pneumoniae
ggaaagaaggtattcataaaataccctctatcaagagtctcctcaaaaacaggaccgatgattacaggcaggacaaaagataagatagtcgataaaaaggttggttgtccatttgaaaaaagcacggtaaaatactcatca

SEQ ID NO: 119 - DNA, 111 bp, Streptococcus pneumoniae
tcttcaccagtttttcctaaacttgtaatggtatctggggcaaataaaccaagagaaaggcgcaatttcccattttcgtctaaaatgtcattccacttaacctttgtcttg

SEQ ID NO: 120 - DNA, 231 bp, Streptococcus pneumoniae
tacttaacttccttctcagttccgaagatagcttcttcaaaggtcaaattgacacgatactggagatcatctccttggcgaggagcgtttggattgcgcgaagaaccgcctccgccgaagaaacttgagaaaatatcctcaaaaccaccgaagccacctgccccattgaaaccgccgaaaccaccagctccaccaaaaccaccattggcgcctgcagcaccatactggtca

SEQ ID NO: 121 - DNA, 267 bp, Streptococcus pneumoniae
cagtcatggcgtcctattccagattcaaaatgctatacacaagaaaaactcactatccccattaaaagaagaaaagacatcaaggacttctaccacaattccatccaaagacacaaaaacagccataagagtcacctccttgattcctataggctgattataacaagactggctgaaattgtacatgaaaataaaatcctaatagtactcattttgtatgtgactaatattccgtctcgctccagaaggtacgaagtaaatagagtt

SEQ ID NO: 122 - DNA, 180 bp, Streptococcus pneumoniae
ctgtttcgtttttatcgtgtaattgttctttatcgaggttggcatatttatcttttaattcttgtgaatttgcagtacgttcaaaacgttttccgaaaggatcgattccttgttcgcggagcgcagccattttttcacggcgaacgatctgctggtcatttagttcttccatatgttctg

SEQ ID NO: 123 - DNA, 180 bp, Streptococcus pneumoniae
ataactcaccctccactaaaccctgagcattttgtttcaagagtcttttcatctcttggtttgaagtcttatcagccaaaagatgatagatttctgagaaagccttcagatagtaggcatcctgaatcaggtaatagcggaaaatggcaggttctaaattcccctcttgtaattgtaaaa

SEQ ID NO: 124 - DNA, 90 bp, Streptococcus pneumoniae
acattggctaaagcagtcggtttgatgtattctccaccaattccaccaaaaccattcttaggccgaataacgacagattcgtcttctata

SEQ ID NO: 125 - DNA, 249 bp, Streptococcus pneumoniae
cctggttctccattttcagagatttccggtgcaggattttttggtgtcgcgaaacgaatatttccacgtccaccacgaccaccgtgggcaacgataaattcttgcccatgttcaatcaaatctgttaaaaccttgccagtctccgcatcacgaacagtcgtaccttgtggtactcgaactctaaggtcctcagcaccacgaccatgcatccctttggtcatccctttttcaccagaatcagccttgaaa

SEQ ID NO: 126 - DNA, 333 bp, Streptococcus pneumoniae
ataaattccttgaccttggccacatccttatccaaaagaagggcaccaagaaaggcttcaaaggcatcaccaagaatggtgtcacgattgcgaccacctgatttttcttcccctttacccaacttgataaactggtcaaactggcaatcacgcgcaaaaccagctaaactctcctcacggacaatcatagcacggagttttgataggtcaccttcaggctttttaggatattttttatatagatattctgaaatcaataactgtagaacagcgtctcctaaaaattccaagcgttcattgtgtgaaatttttaagaggcggtgctcattggca

SEQ ID NO: 127 - DNA, 147 bp, Streptococcus pneumoniae
ccaataggaaaaaggaattgtaaagctgaatgccaatcccaccacctgcttgaaaagcagaagaccttccagtcaagaaagaccaagagatatggggcaagccccgaaccaagatatagagaatcaaggaagccaagattgtcacaa

SEQ ID NO: 128 - DNA, 174 bp, Streptococcus pneumoniae
cagccattgggacactcgaaagccgaagaacatgagactatctgttcgcataccttcgataaccatacgaccgaaaccataccaaatcaagtaaaaggccgtgatatgacctcgtctgagactcttccatttccgtctaaaaatcagaatcaaggcaaagccaagcagattcca

SEQ ID NO: 129 - DNA, 375 bp, Streptococcus pneumoniae
ccttgctctttacctgattatgggctggttggttctggctatcattcctgccattatcagtcaaacgacacccgttttctggagtctcatggtaactggcggactctgttatacagttggagctggattttatgccaagaaaaaaccttatttccacatgatttggcatctctttatcctagctgcgtccgcacttcaatacatcgctattgtttattacatgtaaaaaagttgagaaattcaatctcaacttttttctttacacatattgataaagtactggtgcaagcgcacatcatcagtcaattctggatgaaaagaacttaccaacatatttttttcttgggctgcaacaatttgattgttcactgttgc

SEQ ID NO: 130 - DNA, 207 bp, Streptococcus pneumoniae
cgagtaaaagataatcatctggataagcttgtgaaagctcttctaaaaaggcgttcatccactcagtattacatccaccagctattaagaaaaatgattcgcctgtatgggcatcaacagctccataacaatagcgaaattctcgtatatagtgactatggacatgtggacctactcctattggagaccaacaagatcccagtttac

SEQ ID NO: 131 - DNA, 120 bp, Streptococcus pneumoniae
caagtcatcaaaatagacatagcaactacaaataaaacggaatctgtaaagagccaaagtgagagagaaaagaaaagattgacaagcagtaatatactaaaggttagagggcgaccgata

SEQ ID NO: 132 - DNA, 96 bp, Streptococcus pneumoniae
gcctttaagagttccaaggtcccatcacttgatccatcatcgacaaagacatactcgatttctgtttccaaatctggaagtaaagcttccagagcc

SEQ ID NO: 133 - DNA, 207 bp, Streptococcus pneumoniae
gataaaactgacccactggctaggaaacttcctgacaaaagtaagccgtcaacttccttttgcaccaaatcactttctcccgttaacatggcttcattgacttccgcaaagccttccaaaaccaaggcatcactaggaatctgctctcctgcagacaaacgaatgacatctcctagcactaattcttcaggattaagagcaacttcc

SEQ ID NO: 134 - DNA, 114 bp, Streptococcus pneumoniae
ttatgccgattacaaacacaagcaaggccacgagggtctgtgaccaatctaacgaagcaaaataaggtatatagatacctaaattatctccgccagacgcaattgtcagcaatg

SEQ ID NO: 135 - DNA, 330 bp, Streptococcus pneumoniae
tgcattcaaagcattggcaatgagggacagtgcaaaggcaatagttgttacgtaggcaaggagattcatcttgcccccatatccgatatagttggtcacaaaggcaaagaggaaggcgatgatggaaatgatgatggccgccaattttacctgtttttggctcatttggttgggtctgccttcttgcgaagcttcccacttctttatagcaaaggtataaatgaggaaggtgacgggataggtaatgatggccgccttatttccaaggatataatcaatagcaccggacaaaatggtattaacaataccaaagtaatttccccatttgct

SEQ ID NO: 136 - DNA, 363 bp, Streptococcus pneumoniae
acgtccacgaagctggttatcgatacgacgactttcatgacgttctgtaccaataacacaaagtcctccaagttcacgaacaccttcaccaagcttgatgtcggtaccacgacccgccatgttggttgcgatggtaacggcaccacgttgaccagcattcatgatgatttgggcttctctatagtggtttttggcattcaagacttcgtgaggaacaccagctgcaaccaatttcttagaaatgtagtcactagtttcaaccgctactgtaccaaccaagacaggttgacccttttggtaacgagccttaacgtcttcgacaaccgctttaaacttagattcgatacttgcataaagaaggtc

SEQ ID NO: 137 - DNA, 81 bp, Streptococcus pneumoniae
atctctactggtgtaccgacctgttcgatgtatccattgttaaagactgcaattctatcagataaagtcaaggcttcctct

SEQ ID NO: 138 - DNA, 102 bp, Streptococcus pneumoniae
ttaagtaccatgtccagcataaagtcaatcttgtgctctttaccgacacacaccattttctcaaaatcagccatatcaccaaaaagaggatccactgccata

SEQ ID NO: 139 - DNA, 333 bp, Streptococcus pneumoniae
agctgctcatactcatctaccaactccaaggcatgctcaatcgtcggtttatcaaaaccaacaatattcatctgtgtcacacccatctcagcagccaaggcaatttcttctgcctcacgacctgcaaattcttctacattcaagtgtgtatgtgtatcaaaaatcatctcttctaacctcgttttctatcttctattataccaaaaaagaggaggggcacctaatttttcggtttcccctcctctcttcaatagagagctattctgctatcttttctatccgatattgcccatctcctattccacagttagagacagaagagattggctacat

SEQ ID NO: 140 - DNA, 330 bp, Streptococcus pneumoniae
gtaacatcttgcattgttcctgcagttgcttgcggtgcacttgttgtcttaggagcagcattaggagccactggtctcttaggaactgtaaccatggcaatggcttgcactccaatcgtttctgcttccttcacatcttccatagttttcgcattttcaatctctttgagagctgcttgtttttctgcttccactcttgctaaaagttctgctttttctttatcagaaagcggtgcgcctttgatttcatcctgcttgtccttggctgctttttcaatggcatttttagctgattctttttcagtagctaattgcttagaagcttgtgat

SEQ ID NO: 141 - DNA, 159 bp, Streptococcus pneumoniae
tattctcctttcaaccactccattctcataaggaaaacgacgaaaatcataaatccaaaccccaaagcaccacgaatgaattggcgaagcaaggtttggtcaaaccaacctgtaaacatttccactaaccataccaagagtgacaggccgataaagaaa

SEQ ID NO: 142 - DNA, 144 bp, Streptococcus pneumoniae
gattatttcaagtttcgaacaacttttacaagattttctacagtaaagccatattctgccaatacttttggtgctggggcagaggctccgaaggtatcaatacctagaacggcaccatcgagaccaacatatttgtaccagttt

SEQ ID NO: 143 - DNA, 222 bp, Streptococcus pneumoniae
agaggcagacgtggattatgcgttgcacgaatcaaggctcctagactagtcattaaacctaagagaacaatcgatccgcctaccaaagatagatacagtccaccactctcagctacatccctctccgtccccaaaagtcctatcatctctttcccagcgaagatggacaaaaatcctaaaaggaaacttaatagtaaggtaatcttcaacgcctcagtcaca

SEQ ID NO: 144 - DNA, 90 bp, Streptococcus pneumoniae
actcctccatataccaaaattcctgccaaaacagctataataccatttatttcagctcaagatttcaaccaagcccaacggctctctgga

SEQ ID NO: 145 - protein, 122 aa, Streptococcus pneumoniae
MSKNIVQLNNSFIQNEYQRRRYLMKERQKRNRFMGGVLILIMLLFILPTFNLAQSYQQLLQRRQQLADLQTQYQTLSDEKDKETAFATKLKDEDYAAKYTRAKYYYSKSREKVYTIPDLLQR

SEQ ID NO: 146 - protein, 877 aa, Streptococcus pneumoniae
MDKKKLLLIDGSSVAFRAFFALYQQLDRFKNVAGLHTNAIYGFQLMLSHLLERVEPSHILVAFDAGKTTFRTEMYADYKGGRAKTPDEFREQFPFIRELLDHMGIRHYDLAQYEADDIIGTLDKLAEQDGFDITIVSGDKDLIQLTDEHTVVEISKKGVAEFEAFTPDYLMEEMGLTPAQFIDLKALMGDKSDNIPGVTKVGEKTGIKLLLEHGSLEGIYENIDGMKTSKMKENLINDKEQAFLSKTLATIDTKAPIAIGLEDLVYSGPDVENLGKFYDEMGFKQLKQALNVSSADVSESLDFTIVDQISQDMLSEESIFHFELFGENYHTDNLVGFVWSCGDKLYATDKLELLQDPIFKDFLEKTSLRVYDFKKVKVLLQRFGVDLQAPAFDIRLAKYLLSTVEDNEIATIASLYGQTYLVDDETFYGKGVKKAIPEREKFLEHLACKLAVLVETEPILLEKLSENGQLELLYDMEQPLAFVLAKMEIAGIMVKKETLLEMQAENELVIEKLTQEIYELAGEEFNVNSPKQLGVLLFEKLGLPLEYTKKTKTGYSTAVDVLERLAPIAPIVKKILDYRQIAKIQSTYVIGLQDWILADGKIHTRYVQDLTQTGRLSSVDPNLQNIPARLEQGRLIRKAFVPEWEDSVLLSSDYSQIELRVLAHISKDEHLIKAFQEGADIHTSTAMRVFGIERPDDVTANDRRNAKAVNFGVVYGISDFGLSNNLGISRKEAKAYIDTYFERFPGIKNYMDEVVREARDKGYVETLFKRRRELPDINSRNFNIRGFAERTAINSPIQGSAADILKIAMIQLDKALVAGGYQTKMLLQVHDEIVLEVPKSELVEMKKLVKQTMEEAIQLSVPLIADENEGATWYEAK

SEQ ID NO: 147 - protein, 211 aa, Streptococcus pneumoniae
MGMAAFKNPNNQYKAITIAQTLGDDASSEELAGRYGSAVQCTEVTASNLSTVKTKATVVEKPLKDFRASTSDQSGWVESNGKWYFYESGDVKTGWVKTDGKWYYLNDLGVMQTGFVKFSGSWYYLSNSGAMFTGWGTDGSRWFYFDGSGAMKTGWYKENGTWYYLDEAGIMKTGWFKVGPHWYYAYGSGALAVSTTTPDGYRVNGNGEWVN

SEQ ID NO: 148 - protein, 1856 aa, Streptococcus pneumoniae
MSRKSIGEKRHSFSMRKLSVGLVSVTVSSFFLMSQGIQSVSADNMESPIHYKYMTEGKLTDEEKSLLVEALPQLAEESDDTYYLVYRSQQFLPNTGFNPTVGTFLFTAGLSLLVLLVSKRENGKKRLVHFLLLTSMGVQLLPASAFGLTSQILSAYNSQLSIGVGEHLPEPLKIEGYQYIGYIKTKKQDNTELSRTVDGKYSAQRDSQPNSTKTSDVVHSADLEWNQGQGKVSLQGEASGDDGLSEKSSIAADNLSSNDSFASQVEQNPDHKGESVVRPTVPEQGNPVSATTVQSAEEEVLATTNDRPEYKLPLETKGTQEPGHEGEAAVREDLPVYTKPLETKGTQGPGHEGEAAVREEEPAYTEPLATKGTQEPGHEGKATVREETLEYTEPVATKGTQEPEHEGEAAVEEELPALEVTTRNRTEIQNIPYTTEEIQDPTLLKNRRKIERQGQAGTRTIQYEDYIVNGNVVETKEVSRTEVAPVNEVVKVGTLVKVKPTVEITNLTKVENKKSITVSYNLIDTTSAYVSAKTQVFHGDKLVKEVDIENPAKEQVISGLDYYTPYTVKTHLTYNLGENNEENTETSTQDFQLEYKKIEIKDIDSVELYGKENDRYRRYLSLSEAPTDTAKYFVKVKSDRFKEMYLPVKSITENTDGTYKVTVAVDQLVEEGTDGYKDDYTFTVAKSKAEQPGVYTSFKQLVTAMQSNLSGVYTLASDMTADEVSLGDKQTSYLTGAFTGSLIGSDGTKSYAIYDLKKPLFDTLNGATVRDLDIKTVSADSKENVAALAKAANSANINNVAVEGKISGAKSVAGLVASATNTVIENSSFTGKLIANHQDSNKNDTGGIVGNITGNSSRVNKVRVDALISTNARNNNQTAGGIVGRLENGALISNSVATGEIRNGQGYSRVGGIVGSTWQNGRVNNVVSNVDVGDGYVITGDQYAAADVKNASTSVDNRKADRFATKLSKDQIDAKVADYGITVTLDDTGQDLKRNLREVDYTRLNKAEAERKVAYSNIEKLMPFYNKDLVVHYGNKVATTDKLYTTELLDVVPMKDDEVVTDINNKKNSINKVMLHFKDNTVEYLDVTFKENFINSQVIEYNVTGKEYIFTPEAFVSDYTAITNNVLSDLQNVTLNSEATKKVLGAANDAALDNLYLDRQFEEVKANIAEHLRKVLAMDKSINTTGDGVVEYVSEKIKNNKEAFMLGLTYMNRWYDINYGKMNTKDLSTYKFDFNGNNETSTLDTIVALGNSGLDNLRASNTVGLYANKLASVKGEDSVFDFVEAYRKLFLPNKTNNEWFKENTKAYIVEMKSDIAEVREKQESPTADRKYSLGVYDRISAPSWGHKSMLLPLLTLPEESVYISSNMSTLAFGSYERYRDSVDGVILSGDALRTYVRNRVDIAAKRHRDHYDIWYNLLDSASKEKLFRSVIVYDGFNVKDETGRTYWARLTDKNIGSIKEFFGPVGKWYEYNSSAGAYANGSLTHFVLDRLLDAYGTSVYTHEMVHNSDSAIYFEGNGRREGLGAELYALGLLQSVDSVNSHILALNTLYKAEKDDLNRLHTYNPVERFDSDEALQSYMHGSYDVMYTLDAMEAKAILAQNNDVKKKWFRKIENYYVRDTRHNKDTHAGNKVRPLTDEEVANLTSLNSLIDNDIINRRSYDDSREYKRNGYYTISMFSPVYAALSNSKGAPGDIMFRKIAYELLAEKGYHKGFLPYVSNQYGAEAFASGSKTFSSWHGRDVALVTDDLVFKKVFNGEYSSWADFKKAMFKQRIDKQDNLKPITIQYELGNPNSTKEVTITTAAQMQQLINEAAAKDITNIDRATSHTPASWVHLLKQKIYNAYLRTTDDFRNSIYK

SEQ ID NO: 149 - protein, 857 aa, Streptococcus pneumoniae
MKFNPNQRYTRWSIRRLSVGVASVVVASGFFVLVGQPSSVRADGLNPTPGQVLPEETSGTKEGDLSEKPGDTVLTQAKPEGVTGNTNSLPTPTERTEVSEETSPSSLDTLFEKDEEAQKNPELTDVLKETVDTADVDGTQASPAETTPEQVKGGVKENTKDSIDVPAAYLEKAEGKGPFTAGVNQVIPYELFAGDGMLTRLLLKASDNAPWSDNGTAKNPALPPLEGLTKGKYFYEVDLNGNTVGKQGQALIDQLRANGTQTYKATVKVYGNKDGKADLTNLVATKNVDININGLVAKETVQKAVADNVKDSIDVPAAYLEKAKGEGPFTAGVNHVIPYELFAGDGMLTRLLLKASDKAPWSDNGDAKNPALSPLGENVKTKGQYFYQVALDGNVAGKEKQALIDQFRANGTQTYSATVNVYGNKDGKPDLDNIVATKKVTININGLISKETVQKAVADNVKDSIDVPAAYLEKAKGEGPFTAGVNHVIPYELFAGDGMLTRLLLKASDKAPWSDNGDAKNPALSPLGENVKTKGQYFYQLALDGNVAGKEKQALIDQFRANGTQTYSATVNVYGNKDGKPDLDNIVATKKVTININGLISKETVQKAVADNVKDSIDVPAAYLEKAKGEGPFTAGVNHVIPYELFAGDGMLTRLLLKASDKAPWSDNGDAKNPALSPLGENVKTKGQYFYQVALDGNVAGKEKQALIDQFRANGTQTYSATVNVYGNKDGKPDLDNIVATKKVTIKINVKETSDTANGSLSPSNSGSGVTPMNHNHATGTTDSMPADTMTSSTNTMAGENMAASANKMSDTMMSEDKAMLPNTGETQTSMASIGFLGLALAGLLGGLGLKNKKEEN

SEQ ID NO: 150 - protein, 195 aa, Streptococcus pneumoniae
MKSITKKIKATLAGVAALFAVFAPSFVSAQESSTYTVKEGDTLSEIAETHNTTVEKLAENNHIDNIHLIYVDQELVIDGPVAPVATPAPATYAAPAAQDETVSAPVAETPVVSETVVSTVSGSEAEAKEWIAQKESGGSYTATNGRYIGRYQLTDSYLNGDYSAENQERVADAYVAGRYGSWTAAKNFWLNNGWY

SEQ ID NO: 151 - protein, 744 aa, Streptococcus pneumoniae
MNKKKMILTSLASVAILGAGFVTSQPTFVRAEESPQVVEKSSLEKKYEEAKAKADTAKKDYETAKKKAEDAQKKYEDDQKRTEEKARKEAEASQKLNDVALVVQNAYKEYREVQNQRSKYKSDAEYQKKLTEVDSKIEKARKEQQDLQNKFNEVRAVVVPEPNALAETKKKAEEAKAEEKVAKRKYDYATLKVALAKKEVEAKELEIEKLQYEISTLEQEVATAQHQVDNLKKLLAGADPDDGTEVIEAKLKKGEAELNAKQAELAKKQTELEKLLDSLDPEGKTQDELDKEAEEAELDKKADELQNKVADLEKEISNLEILLGGADPEDDTAALQNKLAAKKAELAKKQTELEKLLDSLDPEGKTQDELDKEAEEAELDKKADELQNKVADLEKEISNLEILLGGADSEDDTAALQNKLATKKAELEKTQKELDAALNELGPDGDEEETPAPAPQPEQPAPAPKPEQPAPAPKPEQPAPAPKPEQPAPAPKPEQPAPAPKPEQPAKPEKPAEEPTQPEKPATPKTGWKQENGMWYFYNTDGSMAIGWLQNNGSWYYLNANGAMATGWVKDGDTWYYLEASGAMKASQWFKVSDKWYYVNSNGAMATGWLQYNGSWYYLNANGDMATGWLQYNGSWYYLNANGDMATGWAKVNGSWYYLNANGAMATGWAKVNGSWYYLNANGSMATGWVKDGDTWYYLEASGAMKASQWFKVSDKWYYVNGLGALAVNTTVDGYKVNANGEWV

SEQ ID NO: 152 - protein, 189 aa, Streptococcus pneumoniae
MKKIVLVSLAFLFVLVGCGQKKETGPATKTEKDTLQSALPVIENAEKNTVVTKTLVLPKSDDGSQQTQTITYKDKTFLSLAIQQKRPVSDELKTYIDQHGVEETQKALLEAEEKDKSIIEARKLAGFKLETKLLSATELQTTTSFDFQVLDVKKASQLEHLKNIGLENLLKNEPSKYISDRLANGATEQ

SEQ ID NO: 153 - protein, 416 aa, Streptococcus pneumoniae
MFEVEEWLHSRIGLNFRSGLGRMQQAVDLLGNPEQSYPIIHVTGTNGKGSTIAFMRELFMGHGKKVATFTSPHIVSINDRICINGQPIADADFIRLTDQVKEMEKTLLQTPAQLSFFELLTLVAFLYFREQEVDLVLLEVGIGGLLDTTNVVTGEFAVITSIGLDHQETLGDSLEAIAEQKAGIFKAGKKAVIAKLPPEARLACQKKAESLAVNLYQAGQDFLMLNGDFSSSLLNLSQLNIGLEGVYQQENAALALQTFLLFMRERKEAVDEQAVRKALEQTHWAGRLERIRPQIYLDGAHNLPALTRLAEFIKEKEQEGYRPQILFGSLKRKDYQGMLGYLTEKLPQVELKVTGFDYQGALDERDVTGYDIVSSYREFISDFEERADAQDLLFVTGSLYFISEVRGYLLDREQIN

SEQ ID NO: 154 - protein, 277 aa, Streptococcus pneumoniae
VGIRVYKPTTNGRRNMTSLDFAEITTSTPEKSLLVALKSKAGRNNNGRITVRHQGGGHKRFYRLVDFKRNKDNVEAVVKTIEYDPNRSANIALVHYTDGVKAYIIAPKGLEVGQRIVSGPEADIKVGNALPLANIPVGTLIHNIELKPGRGGELVRAAGASAQVLGSEGKYVLVRLQSGEVRMILGTCRATVGVVGNEQHGLVNLGKAGRSRWKGIRPTVRGSVMNPNDHPHGGGEGKAPVGRKAPSTPWGKPALGLKTRNKKAKSDKLIVRRRNEK

SEQ ID NO: 155 - protein, 89 aa, Streptococcus pneumoniae
MAKKSMVAREAKRQKIVDRYAEKRAALKAAGDYEGLSKLPRNASPTRLHNRCRVTGRPHSVYRKFGLSRIAFRELAHKGQIPGVTKASW

SEQ ID NO: 156 - protein, 445 aa, Streptococcus pneumoniae
MDIRQVTETIAMIEEQNFDIRTITMGISLLDCIDPDINRAAEKIYQKITTKAANLVAVGDEIAAELGIPIVNKRVSVTPISLIGAATDATDYVVLAKALDKAAKEIGVDFIGGFSALVQKGYQKGDEILINSIPRALAETDKVCSSVNIGSTKSGINMTAVADMGRIIKETANLSDMGVAKLVVFANAVEDNPFMAGAFHGVGEADVIINVGVSGPGVVKRALEKVRGQSFDVVAETVKKTAFKITRIGQLVGQMASERLGVEFGIVDLSLAPTPAVGDSVARVLEEMGLETVGTHGTTAALALLNDQVKKGGVMACNQVGGLSGAFIPVSEDEGMIAAVQNGSLNLEKLEAMTAICSVGLDMIAIPEDTPAETIAAMIADEAAIGVINMKTTAVRIIPKGKEGDMIEFGGLLGTAPVMKVNGASSVDFISRGGQIPAPIHSFKN

SEQ ID NO: 157 - protein, 812 aa, Streptococcus pneumoniae
MVNTEVARTTIKTEYFGSLTERMNKYREDVLNKKPYIDAERAVLATRAYERYKEQPNVLKRAYMLKEILENMTIYIEEESMIAGNQASSNKDAPIFPEYTLEFVLNELDLFEKRDGDVFYITEETKEQLRSIAPFWENNNLRARAGALLPEEVSVYMETGFFGMEGKMNSGDAHLAVNYQKLLQFGLRGFEERARKAKVALDLTDPASIDKYHFYDSIFIVIDAIKVYAKRFVALAKSLAENANPKRKKELLEIADICSRVPYEPATTFAEAIQSVWFIQCILQIESNGHSLSYGRFDQYMYPYMKADLESGKETEDSIVERLTNLWIKTITINKVRSQSHTFSSAGSPLYQNVTIGGQTRDKKDAVNPLSYLVLKSVAQTHLPQPNLTVRYHAGLDARFMNECIEVMKLGFGMPAFNNDEIIIPSFIAKGVLEDDAYDYSAIGCVETAVPGKWGYRCTGMSYMNFPKVLLITMNDGIDPASGKRFAPSFGRFKDMKNFSELENAWDKTLRYLTRMSVIVENSIDLSLEREVPDILCSALTDDCIGRGKHLKEGGAVYDYISGLQVGIANLSDSLAAIKKLVFEEERISPSQLWHALETDYAGEEGKVIQEMLIHDAPKYGNDDDYADKLVTAAYDIYVDEIAKYPNTRYGRGPIGGIRYSGTSSISANVGQGRGTLATPDGRNAGTPLAEGCSPSHNMDQHGPTSVLKSVSKLPTDEIVGGVLLNQKVNPQTLAKEEDKLKLIALLRTFFNRLHGYHIQYNVVSRETLIDAQKHPEKHRDLIVRVAGYSAFFNVLSKATQDDIIGRTEHTL

SEQ ID NO: 158 - protein, 130 aa, Streptococcus pneumoniae
MSQAQYAGTGRRKNAVARVRLVPGTGKITVNKKDVEEYIPHADLRLVINQPFAVTSTVGSYDVFVNVIGGGYAGQSGAIRHGIARALLQVDPDFRDSLKRAGLLTRDSRKVERKKPGLKKARKASQFSKR

SEQ ID NO: 159 - protein, 333 aa, Streptococcus pneumoniae
LEKKLTIKDIAEMAQTSKTTVSFYLNGKYEKMSQETREKIEKVIHETNYKPSIVARSLNSKRTKLIGVLIGDITNSFSNQIVKGIEDIASQNGYQVMIGNSNYSQESEDRYIESMLLLGVDGFIIQPTSNFRKYSRIIDEKKKKMVFFDSQLYEHRTSWVKTNNYDAVYDMTQSCIEKGYEHFLLITADTSRLSTRIERASGFVDALTDANMRHASLTIEDKHTNLEQIKEFLQKEIDPDEKTLVFIPNCWALPLVFTVIKELNYNLPQVGLIGFDNTEWTCFSSPSVSTLVQPSFEEGQQATKILIDQIEGRNQEERQQVLDCSVNWKESTF

SEQ ID NO: 160 - protein, 1767 aa, Streptococcus pneumoniae
MNKGLFEKRCKYSIRKFSLGVASVMIGAAFFGTSPVLADSVQSGSTANLPADLATALATAKENDGRDFEAPKVGEDQGSPEVTDGPKTEEELLALEKEKPAEEKPKEDKPAAAKPETPKTVTPEWQTVANKEQQGTVTIREEKGVRYNQLSSTAQNDNAGKPALFEKKGLTVDANGNATVDLTFKDDSEKGKSRFGVFLKFKDTKNNVFVGYDKDGWFWEYKSPTTSTWYRGSRVAAPETGSTNRLSITLKSDGQLNASNNDVNLFDTVTLPAAVNDHLKNEKKILLKAGSYDDERTVVSVKTDNQEGVKTEDTPAEKETGPEVDDSKVTYDTIQSKVLKAVIDQAFPRVKEYSLNGHTLPGQVQQFNQVFINNHRITPEVTYKKINETTAEYLMKLRDDAHLINAEMTVRLQVVDNQLHFDVTKIVNHNQVTPGQKIDDESKLLSSISFLGNALVSVSSNQTGAKFDGATMSNNTHVSGDDHIDVTNPMKDLAKGYMYGFVSTDKLAAGVWSNSQNSYGGGSNDWTRLTAYKETVGNANYVGIHSSEWQWEKAYKGIVFPEYTKELPSAKVVITEDANADKNVDWQDGAIAYRSIMNNPQGWEKVKDITAYRIAMNFGSQAQNPFLMTLDGIKKINLHTDGLGQGVLLKGYGSEGHDSGHLNYADIGKRIGGVEDFKTLIEKAKKYGAHLGIHVNASETYPESKYFNEKILRKNPDGSYSYGWNWLDQGINIDAAYDLAHGRLARWEDLKKKLGDGLDFIYVDVWGNGQSGDNGAWATHVLAKEINKQGWRFAIEWGHGGEYDSTFHHWAADLTYGGYTNKGINSAITRFIRNHQKDAWVGDYRSYGGAANYPLLGGYSMKDFEGWQGRSDYNGYVTNLFAHDVMTKYFQHFTVSKWENGTPVTMTDNGSTYKWTPEMRVELVDADNNKVVVTRKSNDVNSPQYRERTVTLNGRVIQDGSAYLTPWNWDANGKKLSTDKEKMYYFNTQAGATTWTLPSDWAKSKVYLYKLTDQGKTEEQELTVKDGKITLDLLANQPYVLYRSKQTNPEMSWSEGMHIYDQGFNSGTLKHWTISGDASKAEIVKSQGANDMLRIQGNKEKVSLTQKLTGLKPNTKYAVYVGVDNRSNAKASITVNTGEKEVTTYTNKSLALNYVKAYAHNTRRDNATVDDTSYFQNMYAFFTTGADVSNVTLTLSREAGDQATYFDEIRTFENNSSMYGDKHDTGKGTFKQDFENVAQGIFPFVVGGVEGVEDNRTHLSEKHNPYTQRGWNGKKVDDVIEGNWSLKTNGLVSRRNLVYQTIPQNFRFEAGKTYRVTFEYEAGSDNTYAFVVGKGEFQSGRRGTQASNLEMHELPNTWTDSKKAKKATFLVTGAETGDTWVGIYSTGNASNTRGDSGGNANFRGYNDFMMDNLQIEEITLTGKMLTENALKNYLPTVAMTNYTKESMDALKEAVFNLSQADDDISVEEARAEIAKIEALKNALVQKKTALVADDFASLTAPAQAQEGLANAFDGNVSSLWHTSWNGGDVGKPATMVLKEPTEITGLRYVPRGSGSNGNLRDVKLVVTDESGKEHTFTATDWPNNNKPKDIDFGKTIKAKKIVLTGTKTYGDGGDKYQSAAELIFTRPQVAETPLDLSGYEAALVKAQKLTDKDNQEEVASVQASMKYATDNHLLTERMVEYFADYLNQLKDSATKPDAPTVEKPEFKLRSLASEQGKTPDYKQEIARPETPEQILPATGESQSDTALILASVSLALSALFVVKTKKD

SEQ ID NO: 161 - protein, 719 aa, Streptococcus pneumoniae
MNKPTILRLIKYLSISFLSLVIAAIVLGGGVFFYYVSKAPSLSESKLVATTSSKIYDNKNQLIADLGSERRVNAQANDIPTDLVKAIVSIEDHRFFDHRGIDTIRILGAFLRNLQSNSLQGGSTLTQQLIKLTYFSTSTSDQTISRKAQEAWLAIQLEQKATKQEILTYYINKVYMSNGNYGMQTAAQNYYGKDLNNLSLPQLALLAGMPQAPNQYDPYSHPEAAQDRRNLVLSEMKNQGYISAEQYEKAVNTPITDGLQSLKSASNYPAYMDNYLKEVINQVEEETGYNLLTTGMDVYTNVDQEAQKHLWDIYNTDEYVAYPDDELQVASTIVDVSNGKVIAQLGARHQSSNVSFGINQAVETNRDWGSTMKPITDYAPALEYGVYDSTATIVHDEPYNYPGTNTPVYNWDRGYFGNITLQYALQQSRNVPAVETLNKVGLNRAKTFLNGLGIDYPSIHYSNAISSNTTESDKKYGASSEKMAAAYAAFANGGTYYKPMYIHKVVFSDGSEKEFSNVGTRAMKETTAYMMTDMMKTVLTYGTGRNAYLAWLPQAGKTGTSNYTDEEIENHIKTSQFVAPDELFAGYTRKYSMAVWTGYSNRLTPLVGNGLTVAAKVYRSMMTYLSEGSNPEDWNIPEGLYRNGEFVFKNGARSTWNSPAPQQPPSTESSSSSSDSSTSQSSSTTPSTNNSTTTNPNNNTQQSNTTPDQQNQNPQPAQP

SEQ ID NO: 162 - protein, 464 aa, Streptococcus pneumoniae
MSKKRRNRHKKEGQEPQFDFDEAKELTVGQAIRKNEEVESGVLPEDSILDKYVKQHRDEIEADKFATRQYKKEEFVETQSLDDLIQEMREAVEKSEASSEEVPSSEDILLPLPLDDEEQGLDPLLLDDENPTEMTEEVEEEQNLSRLDQEDSEKKSKKGFILTVLALVSVIICVSAYYVYRQVARSTKEIETSQSTTANQSDVDDFNTLYDAFYTDSNKTALKNSQFDKLSQLKTLLDKLEGSREHTLAKSKYDSLATQIKAIQDVNAQFEKPAIVDGVLDTNAKAKSDAKFTDIKTGNTELDKVLDKAISLGKSQQTSTSSSSSSQTSSSSSSQASSNTTSEPKPSSSNETRSSRSEVNMGLSSAGVAVQRSASRVAYNQSAIDDSNNSAWDFADGVLEQILATSRSRGYITGDQYILERVNIVNGNGYYNLYKPDGTYLFTLNCKTGYFVGNGAGHADDLDY

SEQ ID NO: 163 - protein, 340 aa, Streptococcus pneumoniae
MKLLKKMMQVALAVFFFGLLATNTVFANTTGGRFVDKDNRKYYVKDDHKAIYWHKIDGKTYYFGDIGEMVVGWQYLEIPGTGYRDNLFDNQPVNEIGLQEKWYYFGQDGALLEQTDKQVLEAKTSENTGKVYGEQYPLSAEKRTYYFDNNYAVKTGWIYEEGHWYYLNKLGNFGDDSYNPLPIGEVAKGWTQDFHVTIDIDRSKPAPWYYLDASGKMLTDWQKVNGKWYYFGSSGSMATGWKYVRGKWYYLDNKNGDMKTGWQYLGNKWYYLRSSGAMVTGWYQDGSTWYYLDPSNGDMKIGWTKVNGKWYYLNSNGAMVTGSQTIDGKVYNFASSGEWI

SEQ ID NO: 164 - protein, 332 aa, Streptococcus pneumoniae
MKILKKTMQVGLTVFFFGLLGTSTVFADDSEGWQFVQENGRTYYKKGDLKETYWRVIDGKYYYFDSLSGEMVVGWQYIPFPSKGSTIGPYPNGIRLEGFPKSEWYYFDKNGVLQEFVGWKTLEIKTKDSVGRKYGEKREDSEDKEEKRYYTNYYFNQNHSLETGWLYDQSNWYYLAKTEINGENYLGGERRAGWINDDSTWYYLDPTTGIMQTGWQYLGNKWYYLRSSGAMATGWYQEGTTWYYLDHPNGDMKTGWQNLGNKWYYLRSSGAMATGWYQDGSTWYYLNAGNGDMKTGWFQVNGNWYYAYSSGALAVNTTVDGYSVNYNGEWVR

SEQ ID NO: 165 - protein, 285 aa, Streptococcus pneumoniae
MVLSKYYGVADGMNVEGRGSANFIKDNVLITAAHNYYRHDYGKEADDIYVLPAVSPSQEPFGKIKVKEVRYLKEFRNLNSKDAREYDLALLILEEPIGAKLGTLGLPTSQKNLTGITVTITGYPSYNFKIHQMYTDKKQVLSDDGMFLDYQVDTLEGSSGSTVYDASHRVVGVHTLGDGANQINSAVKLNERNLPFIYSVLKGYSLEGWKKINGSWYHYRQHDKQTGWQEINDTWYYLDSSGKMLTDWQKVNGKWYYLNSNGAMVTGSQTIDGKVYNFASSGEWI

SEQ ID NO: 166 - protein, 630 aa, Streptococcus pneumoniae
LMKKTFFLLVLGLFCLLPLSVFAIDFKINSYQGDLYIHADNTAEFRQKIVYQFEEDFKGQIVGLGRAGKMPSGFDIDPHPKIQAAKNGAELADVTSEVTEEADGYTVRVYNPGQEGDIVEVDLVWNLKNLLFLYDDIAELNWQPLTDSSESIEKFEFHVRGDKGAEKLFFHTGKLFREGTIEKSNLDYTIRLDNLPAKRGVELHAYWPRTDFASARDQGLKGNRLEEFNKIEDSIVREKDQSKQLVTWVLPSILSISLLLSVCFYFIYRRKTTPSVKYAKNHRLYEPPMELEPMVLSEAVYSTSLEEVSPLVKGAGKFTFDQLIQATLLDVIDRGNVSIISEGDAVGLRLVKEDGLSSFEKDCLNLAFSGKKEETLSNLFADYKVSDSLYRRAKVSDEKRIQARGLQLKSSFEEVLNQMQEGVRKRVSFWGLPDYYRPLTGGEKALQVGMGALTILPLFIGFGLFLYSLDVHGYLYLPLPILGFLGLVLSVFYYWKLRLDNRDGVLNEAGAEVYYLWTSFENMLREIARLDQAELESIVVWNRLLVYATLFGYADKVSHLMKVHQIQVENPDINLYVAYGWHSTFYHSTAQMSHYASVANTASTYSVSSGSGSSGGGFSGGGGGGSIGAF

SEQ ID NO: 167 - protein, 665 aa, Streptococcus pneumoniae
MKSINKFLTMLAALLLTASSLFSAATVFAAGTTTTSVTVHKLLATDGDMDKIANELETGNYAGNKVGVLPANAKEIAGVMFVWTNTNNEIIDENGQTLGVNIDPQTFKLSGAMPATAMKKLTEAEGAKFNTANLPAAKYKIYEIHSLSTYVGEDGATLTGSKAVPIEIELPLNDVVDAHVYPKNTEAKPKIDKDFKGKANPDTPRVDKDTPVNHQVGDVVEYEIVTKIPALANYATANWSDRMTEGLAFNKGTVKVTVDDVALEAGDYALTEVATGFDLKLTDAGLAKVNDQNAEKTVKITYSATLNDKAIVEVPESNDVTFNYGNNPDHGNTPKPNKPNENGDLTLTKTWVDATGAPIPAGAEATFDLVNAQTGKVVQTVTLTTDKNTVTVNGLDKNTEYKFVERSIKGYSADYQEITTAGEIAVKNWKDENPKPLDPTEPKVVTYGKKFVKVNDKDNRLAGAEFVIANADNAGQYLARKADKVSQEEKQLVVTTKDALDRAVAAYNALTAQQQTQQEKEKVDKAQAAYNAAVIAANNAFEWVADKDNENVVKLVSDAQGRFEITGLLAGTYYLEETKQPAGYALLTSRQKFEVTATSYSATGQGIEYTAGSGKDDATKVVNKKITIPQTGGIGTIIFAVAGAAIMGIAVYAYVKNNKDEDQLA

SEQ ID NO: 168 - protein, 279 aa, Streptococcus pneumoniae
MAVMAYPLVSRLYYRVESNQQIADFDKEKATLDEADIDERMKLAQAFNDSLNNVVSGDPWSEEMKKKGRAEYARMLEIHERMGHVEIPVIDVDLPVYAGTAEEVLQQGAGHLEGTSLPIGGNSTHAVITAHTGLPTAKMFTDLTKLKVGDKFYVHNIKEVMAYQVDQVKVIEPTNFDDLLIVPGHDYVTLLTCTPYMINTHRLLVRGHRIPYVAEVEEEFIAANKLSHLYRYLFYVAVGLIVILLWIIRRLRKKKKQPEKALKALKAARKEVKVEDGQQ

SEQ ID NO: 169 - protein, 283 aa, Streptococcus pneumoniae
MSRTKLRALLGYLLMLVACLIPIYCFGQMVLQSLGQVKGHATFVKSMTTEMYQEQQNHSLAYNQRLASQNRIVDPFLAEGYEVNYQVSDDPDAVYGYLSIPSLEIMEPVYLGADYHHLGMGLAHVDGTPLPLDGTGIRSVIAGHRAEPSHVFFRHLDQLKVGDALYYDNGQEIVEYQMMDTEIILPSEWEKLESVSSKNIMTLITCDPIPTFNKRLLVNFERVAVYQKSDPQTAAVARVAFTKEGQSVSRVATSQWLYRGLVVLAFLGILFVLWKLARLLRGK

SEQ ID NO: 170 - protein, 1659 aa, Streptococcus pneumoniae
MKNPFFERRCRYSIRKLSVGACSLMIGAVLFAGPALAEETAVPENSGANTELVSGESEHSTNEADKQNEGEHARENKLEKAEGVAIASETASPASNEAATTETAEAASAAKPEEKASEVVAETPSAEAKPKSDKETEAKPEATNQGDESKPAAEANKTEKEVQPDVPKNTEKTLKPKEIKFNSWEELLKWEPGAREDDAINRGSVVLASRRTGHLVNEKASKEAKVQALSNTNSKAKDHASVGGEEFKAYAFDYWQYLDSMVFWEGLVPTPDVIDAGHRNGVPVYGTLFFNWSNSIADQERFAEALKQDADGSFPIARKLVDMAKYYGYDGYFINQETTGDLVKPLGEKMRQFMLYSKEYAAKVNHPIKYSWYDAMTYNYGRYHQDGLGEYNYQFMQPEGDKVPADNFFANFNWDKAKNDYTIATANWIGRNPYDVFAGLELQQGGSYKTKVKWNDILDENGKLRLSLGLFAPDTITSLGKTGEDYHKNEDIFFTGYQGDPTGQKPGDKDWYGIANLVADRTPAVGNTFTTSFNTGHGKKWFVDGKVSKDSEWNYRSVSGVLPTWRWWQTSTGEKLRAEYDFTDAYNGGNSLKFSGDVAGKTDQDVRLYSTKLEVTEKTKLRVAHKGGKGSKVYMAFSTTPDYKFDDADAWKELTLSDNWTNEEFDLSSLAGKTIYAVKLFFEHEGAVKDYQFNLGQLTISDNHQEPQSPTSFSVVKQSLKNAQEAEAVVQFKGNKDADFYEVYEKDGDSWKLLTGSSSTTIYLPKVSRSASAQGTTQELKVVAVGKNGVRSEAATTTFDWGMTVKDTSLPKPLAENIVPGATVIDSTFPKTEGGEGIEGMLNGTITSLSDKWSSAQLSGSVDIRLTKPRTVVRWVMDHAGAGGESVNDGLMNTKDFDLYYKDADGEWKLAKEVRGNKAHVTDITLDKPITAQDWRLNVVTSDNGTPWKAIRIYNWKMYEKLDTESVNIPMAKAAARSLGNNKVQVGFADVPAGATITVYDNPNSQTPLATLKSEVGGDLASAPLDLTNQSGLLYYRTQLPGKEISNVLAVSVPKDDRRIKSVSLETGPKKTSYAEGEDLDLRGGVLRVQYEGGTEDELIRLTHAGVSVSGFDTHHKGEQNLTLQYLGQPVNANLSVTVTGQDEASPKTILGIEVSQEPKKDYLVGDSLDLSEGRFAVAYSNDTMEEHSFTDEGVEISGYDAQKTGRQTLTLHYQGHEVSFDVLVSPKAALNDEYLKQKLAEVEAAKNKVVYNFASSEVKEAFLKAIEAAEQVLKDHETSTQDQVNDRLNKLTEAHKALNGQEKFTEEKTELDRLTGEVQELLAAKPNHPSGSALAPLLEKNKALVEKVDLSPEELTTAKQSLKDLVALLKEDKPAVFSDSKTGVEVHFSNKEKTVIKGLKVERVQASAEEKKYFAGEDAHVFEIEGLDEKGQDVDLSYASIVKIPIEKDKKVKKVFFLPEGKEAVELAFEQTDSHVIFTAPHFTHYAFVYESAEKPQPAKPAPQNTVLPKPTYQPTSDQQKAPKLEVQEEKVAFHRQEHENTEMLVGEQRVIIQGRDGLLRHVFEVDENGQRRLRSTEVIQEAIPEIVEIGTKVKTVPAVVATQEKPAQNTAVKSEEASKQLPNTGTADANEALIAGLASLGLASLALTLRRKREDKD

SEQ ID NO: 171 - protein, 487 aa, Streptococcus pneumoniae
MSITSFVKRIQDITRNDAGVNGDAQRIEQMSWLLFLKIYDSREMVWELEEDEYESIIPEELKWRNWAHAQNGERVLTGDELLDFVNNKLFKELKELEITSNMPIRKTIVKSAFEDANNYMKNGVLLRQVINVIDEVDFNSPEDRHSFNDIYEKILKDIQNAGNSGEFYTPRAATDFIAEVLDPKLGESMADLACGTGGFLTSTLNRLSSQRKTSEDTKKYNTAVFGIEKKAFPHLLAVTNLFLHEIDDPKIVHGNTLEKNVREYTDDEKFDIIMMNPPFGGSELETIKNNFPAELRSSETADLFMAVIMYRLKENGRVGVILPDGFLFGEGVKTRLKQKLVDEFNLHTIIRLPHSVFAPYTGIHTNILFFDKTKKTEETWFYRLDMPDGYKNFSKTKPMKSEHFNPVRDWWENREEILEGKFYKSKSFTPSELAELNYNLDQCDFPKEEEEILNPFELIQNYQAERATLNHKIDNVLADILQLLEDK

SEQ ID NO: 172 - protein, 378 aa, Streptococcus pneumoniae
MNNTEFYDRLGVSKNASADEIKKAYRKLSKKYHPDINKEPGAEDKYKEVQEAYETLSDDQKRAAYDQYGAAGANGGFGGAGGFGGFNGAGGFGGFEDIFSSFFGGGGSSRNPNAPRQGDDLQYRVNLTFEEAIFGTEKEVKYHREAGCRTCNGSGAKPGTSPVTCGRCHGAGVINVDTQTPLGMMRRQVTCDVCHGRGKEIKYPCTTCHGTGHEKQAHSVHVKIPAGVETGQQIRLAGQGEAGFNGGPYGDLYVVVSVEASDKFEREGTTIFYNLNLNFVQAALGDTVDIPTVHGDVELVIPEGTQTGKKFRLRSKGAPSLRGGAVGDQYVTVNVVTPTGLNDRQKVALKEFAAAGDLKVNPKKKGFFDHIKDAFDGE

SEQ ID NO: 173 - protein, 453 aa, Streptococcus pneumoniae
MNPNLFRSVEFYQRRYHNYATVLIIPLSLLFTFILIFSLVATKEITVTSQGEIAPTSVIASIQSTSDNPILANHLVANQVVEKGDLLIKYSETMEESQKTALATQLQRLEKQKEGLGILKQSLEKATDLFSGEDEFGYHNTFMNFTKQSHDIELGITKTNTEVSNQANLSNSSSSAIEQEITKVQQQIGEYQELRDAIINNRARLPTGNPHQSILNRYLVASQGQTQGTAEEPFLSQINQSIAGLESSIASLKIQQAGIGSVATYDNSLATKIEVLRTQFLQTASQQQLTVENQLTELKVQLDQATQRLENNTLTSPSKGIVHLNSEFEGKNRIPTGTEIAQIFPVITDTREVLITYYVSSDYLPLLDKGQTVRLKLEKIGNHGTTIIGQLQTIDQTPTRTEQGNLFKLTALAKLSNEDSKLIQYGLQGRVTSVTTKKTYFDYFKDKILTHSD

SEQ ID NO: 174 - protein, 131 aa, Streptococcus pneumoniae
MSKKLNRKKQLRNGLRRAGAFSSTVTKVVDETKKVVKRAEQSASAAGKAVSKKVEQAVEATKEQAQKVANSVEDFAANLGGLPLDRAKTFYDEGIKSASDFKNWTEKELLALKGIGPATIKKLKENGIKFK

SEQ ID NO: 175 - protein, 254 aa, Streptococcus pneumoniae
LISLFGLAAAKPVQADTSIADIQKRGELVVGVKQDVPNFGYKDPKTGTYSGIETDLAKMVADELKVKIRYVPVTAQTRGPLLDNEQVDMDIATFTITDERKKLYNFTSPYYTDASGFLVNKSAKIKKIEDLNGKTIGVAQGSITQRLITELGKKKGLKFKFVELGSYPELITSLHAHRIDTFSVDRSILSGYTSKRTALLDDSFKPSDYGIVTKKSNTELNDYLDNLVTKWSKDGSLQKLYDRYKLKPSSHTAD

SEQ ID NO: 176 - protein, 553 aa, Streptococcus pneumoniae
MSNISLTTLGGVRENGKNMYIAEIGESIFVLNVGLKYPENEQLGVDVVIPNMDYLFENSDRIAGVFLTHGHADAIGALPYLLAEAKVPVFGSELTIELAKLFVKGNDAVKKFNDFHVIDENTEIDFGGTVVSFFPTTYSVPESLGIVLKTSEGSIVYTGDFKFDQTASESYATDFARLAEIGRDGVLALLSDSANADSNIQVASESEVRDEITQTIADWEGRIIVAAVSSNLSRIQQIFDAADKTGRRIVLTGFDIENIVRTAIRLKKLSLANEILLIKPKDMSRFEDHELIILETGRMGEPINGLRKMSIGRHRYVEIKDGDLVYIATAPSIAKEAFVARVENMIYQAGGVVKLITQSLHVSGHGNVRDLQLMINLLQPKYLFPVQGEYRELDAHAKAAMAVGMLPERIFIPKKGTTMAYENGDFVPAGSVSAGDILIDGNAIGDVGNVVLRDRKVLSEDGIFIVAITVNRREKKIVARARVHTRGFVYLKKSRDILRESSELINQTVEEYLQGDDFDWADLKGKVRDNLTKYLFDQTKRRPAILPVVMEAK

SEQ ID NO: 177 - protein, 2140 aa, Streptococcus pneumoniae
MKKSTVLSLTTAAVILAAYAPNEVVLADTSSSEDALNISDKEKVAENKEKHENIHSAMETSQDFKEKKTAVIKEKEVVSKNPVIDNNTSNEEAKIKEENSNKSQGDYTDSFVNKNTENPKKEDKVVYIAEFKDKESGEKAIKELSSLKNTKVLYTYDRIFNGSAIETTPDNLDKIKQIEGISSVERAQKVQPMMNHARKEIGVEEAIDYLKSINAPFGKNFDGRGMVISNIDTGTDYRHKAMRIDDDAKASMRFKKEDLKGTDKNYWLSDKIPHAFNYYNGGKITVEKYDDGRDYFDPHGMHIAGILAGNDTEQDIKNFNGIDGIAPNAQIFSYKMYSDAGSGFAGDETMFHAIEDSIKHNVDVVSVSSGFTGTGLVGEKYWQAIRALRKAGIPMVVATGNYATSASSSSWDLVANNHLKMTDTGNVTRTAAHEDAIAVASAKNQTVEFDKVNIGGESFKYRNIGAFFDKSKITTNEDGTKAPSKLKFVYIGKGQDQDLIGLDLRGKIAVMDRIYTKDLKNAFKKAMDKGARAIMVVNTVNYYNRDNWTELPAMGYEADEGTKSQVFSISGDDGVKLWNMINPDKKTEVKRNNKEDFKDKLEQYYPIDMESFNSNKPNVGDEKEIDFKFAPDTDKELYKEDIIVPAGSTSWGPRIDLLLKPDVSAPGKNIKSTLNVINGKSTYGYMSGTSMATPIVAASTVLIRPKLKEMLERPVLKNLKGDDKIDLTSLTKIALQNTARPMMDATSWKEKSQYFASPRQQGAGLINVANALRNEVVATFKNTDSKGLVNSYGSISLKEIKGDKKYFTIKLHNTSNRPLTFKVSASAITTDSLTDRLKLDETYKDEKSPDGKQIVPEIHPEKVKGANITFEHDTFTIGANSSFDLNAVINVGEAKNKNKFVESFIHFESVEEMEALNSNGKKINFQPSLSMPLMGFAGNWNHEPILDKWAWEEGSRSKTLGGYDDDGKPKIPGTLNKGIGGEHGIDKFNPAGVIQNRKDKNTTSLDQNPELFAFNNEGINAPSSSGSKIANIYPLDSNGNPQDAQLERGLTPSPLVLRSAEEGLISIVNTNKEGENQRDLKVISREHFIRGILNSKSNDAKGIKSSKLKVWGDLKWDGLIYNPRGREENAPESKDNQDPATKIRGQFEPIAEGQYFYKFKYRLTKDYPWQVSYIPVKIDNTAPKIVSVDFSNPEKIKLITKDTYHKVKDQYKNETLFARDQKEHPEKFDEIANEVWYAGAALVNEDGEVEKNLEVTYAGEGQGRNRKLDKDGNTIYEIKGAGDLRGKIIEVIALDGSSNFTKIHRIKFANQADEKGMISYYLVDPDQDSSKYQKLGEIAESKFKNLGNGKEGSLKKDTTGVEHHHQENEESIKEKSSFTIDRNISTIRDFENKDLKKLIKKKFREVDDFTSETGKRMEEYDYKYDDKGNIIAYDDGTDLEYETEKLDEIKSKIYGVLSPSKDGHFEILGKISNVSKNAKVYYGNNYKSIEIKATKYDFHSKTMTFDLYANINDIVDGLAFAGDMRLFVKDNDQKKAEIKIRMPEKIKETKSEYPYVSSYGNVIELGEGDLSKNKPDNLTKMESGKIYSDSEKQQYLLKDNIILRKGYALKVTTYNPGKTDMLEGNGVYSKEDIAKIQKANPNLRALSETTIYADSRNVEDGRSTQSVLMSALDGFNIIRYQVFTFKMNDKGEAIDKDGNLVTDSSKLVLFGKDDKEYTGEDKFNVEAIKEDGSMLFIDTKPVNLSMDKNYFNPSKSNKIYVRNPEFYLRGKISDKGGFNWELRVNESVVDNYLIYGDLHIDNTRDFNIKLNVKDGDIMDWGMKDYKANGFPDKVTDMDGNVYLQTGYSDLNAKAVGVHYQFLYDNVKPEVNIDPKGNTSIEYADGKSVVFNINDKRNNGFDGEIQEQHIYINGKEYTSFNDIKQIIDKTLNIKIVVKDFARNTTVKEFILNKDTGEVSELKPHRVTVTIQNGKEMSSTIVSEEDFILPVYKGELEKGYQFDGWEISGFEGKKDAGYVINLSKDTFIKPVFKKIEEKKEEENKPTFDVSKKKDNPQVNHSQLNESHRKEDLQREEHSQKSDSTKDVTATVLDKNNISSKSTTNNPNKLPKTGTASGAQTLLAAGIMFIVGIFLGLKKKNQD

SEQ ID NO: 178 - protein, 2233 aa, Streptococcus pneumoniae
MGKGHWNRKRVYSIRKFAVGACSVMIGTCAVLLGGNIAGESVVYADETLITHTAEKPKEEKMIVEEKADKALETKNIVERTEQSEPSSTEAIASEKKEDEAVTPKEEKVSAKPEEKAPRIESQASNQEKPLKEDAKAVTNEEVNQMIEDRKVDFNQNWYFKLNANSKEAIKPDADVSTWKKLDLPYDWSIFNDFDHESPAQNEGGQLNGGEAWYRKTFKLDEKDLKKNVRLTFDGVYMDSQVYVNGQLVGHYPNGYNQFSYDITKYLQKDGRENVIAVHAVNKQPSSRWYSGSGIYRDVTLQVTDKVHVEKNGTTILTPKLEEQQHGKVETHVTSKIVNTDDKDHELVAEYQIVERGGHAVTGLVRTASRTLKAHESTSLDAILEVERPKLWTVLNDKPALYELITRVYRDGQLVDAKKDLFGYRYYHWTPNEGFSLNGERIKFHGVSLHHDHGALGAEENYKAEYRRLKQMKEMGVNSIRTTHNPASEQTLQIAAELGLLVQEEAFDTWYGGKKPYDYGRFFEKDATHPEARKGEKWSDFDLRTMVERGKNNPAIFMWSIGNEIGEANGDAHSLATVKRLVKVIKDVDKTRYVTMGADKFRFGNGSGGHEKIADELDAVGFNYSEDNYKALRAKHPKWLIYGSETSSATRTRGSYYRPERELKHSNGPERNYEQSDYGNDRVGWGKTATASWTFDRDNAGYAGQFIWTGTDYIGEPTPWHNQNQTPVKSSYFGIVDTAGIPKHDFYLYQSQWVSVKKKPMVHLLPHWNWENKELASKVADSEGKIPVRAYSNASSVELFLNGKSLGLKTFNKKQTSDGRTYQEGANANELYLEWKVAYQPGTLEAIARDESGKEIARDKITTAGKPAAVRLIKEDHAIAADGKDLTYIYYEIVDSQGNVVPTANNLVRFQLHGQGQLVGVDNGEQASRERYKAQADGSWIRKAFNGKGVAIVKSTEQAGKFTLTAHSDLLKSNQVTVFTGKKEGQEKTVLGTEVPKVQTIIGEAPEMPTTVPFVYSDGSRAERPVTWSSVDVSKPGIVTVKGMADGREVEARVEVIALKSELPVVKRIAPNTDLNSVDKSVSYVLIDGSVEEYEVDKWEIAEEDKAKLAIPGSRIQATGYLEGQPIHATLVVEEGNPAAPAVPTVTVGGEAVTGLTSQKPMQYRTLAYGAKLPEVTASAKNAAVTVLQASAANGMRASIFIQPKDGGPLQTYAIQFLEEAPKIAHLSLQVEKADSLKEDQTVKLSVRAHYQDGTQAVLPADKVTFSTSGEGEVAIRKGMLELHKPGAVTLNAEYEGAKDQVELTIQANTEKKIAQSIRPVNVVTDLHQEPSLPATVTVEYDKGFPKTHKVTWQAIPKEKLDSYQTFEVLGKVEGIDLEARAKVSVEGIVSVEEVSVTTPIAEAPQLPESVRTYDSNGHVSSAKVAWDAIRPEQYAKEGVFTVNGRLEGTQLTTKLHVRVSAQTEQGANISDQWTGSELPLAFASDSNPSDPVSNVNDKLISYNNQPANRWTNWNRTNPEASVGVLFGDSGILSKRSVDNLSVGFHEDHGVGVPKSYVIEYYVGKTVPTAPKNPSFVGNEDHVFNDSANWKPVTNLKAPAQLKAGEMNHFSFDKVETYAVRIRMVKADNKRGTSITEVQIFAKQVAAAKQGQTRIQVDGKDLANFNPDLTDYYLESVDGKVPAVTASVSNNGLATVVPSVREGEPVRVIAKAENGDILGEYRLHFTKDKSLLSHKPVAAVKQARLLQVGQALELPTKVPVYFTGKDGYETKDLTVEWEEVPAENLTKAGQFTVRGRVLGSNLVAEITVRVTDKLGETLSDNPNYDENSNQAFASATNDIDKNSHDRVDYLNDGDHSENRRWTNWSPTPSSNPEVSAGVIFRENGKIVERTVTQGKVQFFADSGTDAPSKLVLERYVGPEFEVPTYYSNYQAYDADHPFNNPENWEAVPYRADKDIAAGDEINVTFKAIKAKAMRWRMERKADKSGVAMIEMTFLAPSELPQESTQSKILVDGKELADFAENRQDYQITYKGQRPKVSVEENNQVASTVVDSGEDSFPVLVRLVSESGKQVKEYRIHLTKEKPVSEKTVAAVQEDLPKIEFVEKDLAYKTVEKKDSTLYLGETRVEQEGKVGKERIFTAINPDGSKEEKLREVVEVPTDRIVLVGTKPVAQEAKKPQVSEKADTKPIDSSEASQTNKAQLPSTGSAASQAAVAAGLTLLGLSAGLVVTKGKKED

SEQ ID NO: 179 - protein, 1881 aa, Streptococcus pneumoniae
MAPSVVDAATYHYVNKEIISQEAKDLIQTGKPDRNEVVYGLVYQKDQLPQTGTEASVLTAFGLLTVGSLLLIYKRKKIASVFLVGAMGLVVLPSAGAVDPVATLALASREGVVEMEGYRYVGYLSGDILKTLGLDTVLEETSAKPGEVTVVEVETPQSITNQEQARTENQVVETEEAPKEEAPKTEESPKEEPKSEVKPTDDTLPKVEEGKEDSAEPAPVEEVGGEVESKPEEKVAVKPESQPSDKPAEESKVEQAGEPVAPREDEKAPVEPEKQPEAPEEEKAVEETPKQEESTPDTKAEETVEPKEETVNQSIEQPKVETPAVEKQTEPTEEPKVEQAGEPVAPREDEQAPTAPVEPEKQPEVPEEEKAVEETPKPEDKIKGIGTKEPVDKSELNNQIDKASSVSPTDYSTASYNALGPVLETAKGVYASEPVKQPEVNSETNKLKTAIDALNVDKTELNNTIADAKTKVKEHYSDRSWQNLQTEVTKAEKVAANTDAKQSEVNEAVEKLTATIEKLVELSEKPILTLTSTDKKILEREAVAKYTLENQNKTKIKSITAELKKGEEVINTVVLTDDKVTTETISAAFKNLEYYKEYTLSTTMIYDRGNGEETETLENQNIQLDLKKVELKNIKRTDLIKYENGKETNESLITTIPDDKSNYYLKITSNNQKTTLLAVKNIEETTVNGTPVYKVTAIADNLVSRTADNKFEEEYVHYIEKPKVHEDNVYYNFKELVEAIQNDPSKEYRLGQSMSARNVVPNGKSYITKEFTGKLLSSEGKQFAITELEHPLFNVITNATINNVNFENVEIERSGQDNIASLANTMKGSSVITNVKITGTLSGRNNVAGFVNNMNDGTRIENVAFFGKLHSTSGNGSHTGGIAGTNYRGIVRKAYVDATITGNKTRASLLVPKVDYGLTLDHLIGTKALLTESVVKGKIDVSNPVEVGAIASKTWPVGTVSNSVSYAKIIRGEELFGSNDVDDSDYASAHIKDLYAVEGYSSGNRSFRKSKTFTKLTKEQADAKVTTFNITADKLESDLSPLAKLNEEKAYSSIQDYNAEYNQAYKNLEKLIPFYNKDYIVYQGNKLNKEHHLNTKEVLSVTAMNNNEFITNLDEANKIIVHYADGTKDYFNLSSSSEGLSNVKEYTITDLGIKYTPNIVQKDNTTLVNDIKSILESVELQSQTMYQHLNRLGDYRVNAIKDLYLEESFTDVKENLTNLITKLVQNEEHQLNDSPAARQMIRDKVEKNKAALLLGLTYLNRYYGVKFGDVNIKELMLFKPDFYGEKVSVLDRLIEIGSKENNIKGSRTFDAFGQVLAKYTKSGNLDAFLNYNRQLFTNIDNMNDWFIDATEDHVYIAERASEVEEIKNSKHRAFDNLKRSHLRNTILPLLNIDKAHLYLISNYNAIAFGSAERLGKKSLEDIKDIVNKAADGYRNYYDFWYRLASDNVKQRLLRDAVIPIWEGYNAPGGWVEKYGRYNTDKVYTPLREFFGPMDKYYNYNGTGAYAAIYPNSDDIRTDVKYVHLEMVGEYGISVYTHETTHVNDRAIYLGGFGHREGTDAEAYAQGMLQTPVTGSGFDEFGSLGINMVFKRKNDGNQWYITDPKTLKTREDINRYMKGYNDTLTLLDEIEAESVISQQNKDLNSAWFKKIDREYRDNNKLNQWDKIRNLSQEEKNELNIQSVNDLVDQQLMTNRNPGNGIYKPEAISYNDQSPYVGVRMMTGIYGGNTSKGAPGAVSFKHNAFRLWGYYGYENGFLGYASNKYKQQSKTDGESVLSDEYIIKKISNNTFNTIEEFKKAYFKEVKDKATKGLTTFEVNGSSVSSYDDLLTLFKEAVKKDAETLKQEANGNKTVSMNNTVKLKEAVYKKLLQQTNSFKTSIFK

SEQ ID NO: 180 - protein, 332 aa, Streptococcus pneumoniae
MNKRLFSKMSLVTLPILALFSQSVLAEENIHFSSCKEAWANGYSDIHEGEPGYSAKLDRDHDGVACELKNAPKGAFKAKQSTAIQINTSSATTSGWVKQDGAWYYFDGNGNLVKNAWQGSYYLKADGKMAQSEWIYDSSYQAWYYLKSDGSYAKNAWQGAYYLKSNGKMAQGEWVYDSSYQAWYYLKSDGSYARNAWQGNYYLKSDGKMAKGEWVYDATYQAWYYLTSDGSYAYSTWQGNYYLKSDGKMAVNEWVDGGRYYVGADGVWKEVQASTASSSNDSNSEYSAALGKAKSYNSLFHMSKKRMYRQLTSDFDKFSNDAAQYAIDHLDD

SEQ ID NO: 181 - protein, 450 aa, Streptococcus pneumoniae
MKVIDQFKNKKVLVLGLAKSGESAARLLDKLGAIVTVNDGKPFEDNPAAQSLLEEGIKVITGGHPLELLDEEFALMVKNPGIPYNNPMIEKALAKGIPVLTEVELAYLISEAPIIGITGSNGKTTTTTMIGEVLTAAGQHGLLSGNIGYPASQVAQIASDKDTLVMELSSFQLMGVQEFHPEIAVITNLMPTHIDYHGSFSEYVAAKWNIQNKMTAADFLVLNFNQDLAKDLTSKTEATVVPFSTLEKVDGAYLEDGQLYFRGEVVMAANEIGVPGSHNVENALATIAVAKLRDVDNQTIKETLSAFGGVKHRLQFVDDIKGVKFYNDSKSTNILATQKALSGFDNSKVVLIAGGLDRGNEFDELVPDITGLKKMVILGQSAERVKRAADKAGVAYVEATDIADATRKAYELATQGDVVLLSPANASWDMYANFEVRGDLFIDTVAELKE

SEQ ID NO: 182 - protein, 386 aa, Streptococcus pneumoniae
MKKKFALSFVALASVALLAACGEVKSGAVNTAGNSVEEKTIKIGFNFEESGSLAAYGTAEQKGAQLAVDEINAAGGIDGKQIEVVDKDNKSETAEAASVTTNLVTQSKVSAVVGPATSGATAAAVANATKAGVPLISPSATQDGLTKGQDYLFIGTFQDSFQGKIISNYVSEKLNAKKVVLYTDNASDYAKGIAKSFRESYKGEIVADETFVAGDTDFQAALTKMKGKDFDAIVVPGYYNEAGKIVNQARGMGIDKPIVGGDGFNGEEFVQQATAEKASNIYFISGFSTTVEVSAKAKAFLDAYRAKYNEEPSTFAALAYDSVHLVANAAKGAKNSGEIKNNLAKTKDFEGVTGQTSFDADHNTVKTAYMMTMNNGKVEAAEVVKP

SEQ ID NO: 183 - protein, 513 aa, Streptococcus pneumoniae
MSILEVKNLSHGFGDRAIFEDVSFRLLKGEHIGLVGANGEGKSTFMSIVTGKMLPDEGKVEWSKYVTAGYLDQHSVLAERQSVRDVLRTAFDELFKAEARINDLYMKMAEDGADVDALMEEVGELQDRLESRDFYTLDAKIDEVARALGVMDFGMDTDVTSLSGGQRTKVLLAKLLLEKPDILLLDEPTNYLDAEHIDWLKRYLQNYENAFVLISHDIPFLNDVINIVYHVENQQLTRYSGDYYQFQEVYAMKKSQLEAAYERQQKEIADLKDFVARNKARVATRNMAMSRQKKLDKMDIIELQSEKPKPSFDFKPARTPGRFIFQAKNLQIGYDRPLTKPLNLTFERNQKVAIIGANGIGKTTLLKSLLGIISPIAGEVERGDYLELGYFEQEVEGGNRQTPLEAVWNAFPALNQAEVRAALARCGLTTKHIESQIQVLSGGEQAKVRFCLLMNRENNVLVLDEPTNHLDVDAKDELKRALKEYRGSILMVCHEPDFYEGWIDQIWDFNNLT

SEQ ID NO: 184 - protein, 399 aa, Streptococcus pneumoniae
MKKKNGKAKKWQLYAAIGAASVVVLGAGGILLFRQPSQTALKDEPTHLVVAKEGSVASSVLLSGTVTAKNEQYVYFDASKGDLDEILVSVGDKVSEGQALVKYSSSEAQAAYDSASRAVARADRHINELNQARNEAASAPAPQLPAPVGGEDATVQSPTPVAGNSVASIDAQLGDARDARADAAAQLSKAQSQLDATTVLSTLEGTVVEVNSNVSKSPTGASQVMVHIVSNENLQVKGELSEYNLANLSVGQEVSFTSKVYPDKKWTGKLSYISDYPKNNGEAASPAAGNNTGSKYPYTIDVTGEVGDLKQGFSVNIEVKSKTKAILVPVSSLVMDDSKNYVWIVDEQQKAKKVEVSLGNADAENQEITSGLTNGAKVISNPTSSLEEGKEVKADEATN

SEQ ID NO: 185 - protein, 230 aa, Streptococcus pneumoniae
SETNHEIDSNFAGRLNILRAGVLDANDGIISIAGVVIGVASATTNIWIIFLSGFTAILAGAFSMAGGEYVSVSTPKDTEEAAVSREKLLLDQDRELAKKSLYAAYIQNGEFKTSAQLLTNKIFLKNPLKALVEEKYGIEYEEFTNPWHAAISSFVAFFLRSLPPMLSVTIFPSDYRIPATVLIVGVALLLTGYTSARLGKAPTKTAMIRNLAIGLLTMGVTFLLGQLFSI

SEQ ID NO: 186 - protein, 627 aa, Streptococcus pneumoniae
MKKKLTSLALVGAFLGLSWYGNVQAQESSGNKIHFINVQEGGSDAIILESNGHFAMVDTGEDYDFPDGSDSRYPWREGIETSYKHVLTDRVFRRLKELGVQKLDFILVTHTHSDHIGNVDELLSTYPVDRVYLKKYSDSRITNSERLWDNLYGYDKVLQTAAEKGVSVIQNITQGDAHFQFGDMDIQLYNYENETDSSGELKKIWDDNSNSLISVVKVNGKKIYLGGDLDNVHGAEDKYGPLIGKVDLMKFNHHHDTNKSNTKDFIKNLSPSLIVQTSDSLPWKNGVDSEYVNWLKERGIERINAASKDYDATVFDIRKDGFVNISTSYKPIPSFQAGWHKSAYGNWWYQAPDSTGEYAVGWNEIEGEWYYFNQTGILLQNQWKKWNNHWFYLTDSGASAKNWKKIAGIWYYFNKENQMEIGWIQDKEQWYYLDVDGSMKTGWLQYMGQWYYFAPSGEMKMGWVKDKETWYYMDSTGVMKTGEIEVAGQHYYLEDSGAMKQGWHKKANDWYFYKTDGSRAVGWIKDKDKWYFLKENGQLLVNGKTPEGYTVDSSGAWLVDVSIEKSATIKTTSHSEIKESKEVVKKDLENKETSQHESVTNFSTSQDLTSSTSQSSETSVNKSESEQ

SEQ ID NO: 187 - protein, 456 aa, Streptococcus pneumoniae
MDLGPTQRGISVVSQSYINVIGAGLAGSEAAYQIAERGIPVKLYEMRGVKSTPQHKTDNFAELVCSNSLRGDALTNAVGLLKEEMRRLGSVILESAEATRVPAGGALAVDRDGFSQMVTEKVANHPLIEVVRDEITELPTDVITVIATGPLTSDALAEKIHALNDGAGFYFYDAAAPIIDVNTIDMSKVYLKSRYDKGEAAYLNAPMTKQEFMDFHEALVNAEEAPLSSFEKEKYFEGCMPIEVMAKRGIKTMLYGPMKPVGLEYPDDYTGPRDGEFKTPYAVVQLRQDNAAGSLYNIVGFQTHLKWGEQKRVFQMIPGLENAEFVRYGVMHRNSYMDSPNLLEQTYRSKKQPNLFFAGQMTGVEGYVESAASGLVAGINAARLFKEESEAIFPETTAIGSLAHYITHADSKHFQPMNVNFGIIKELEGERIRDKKARYEKIAERALADLEEFLTV

SEQ ID NO: 188 - protein, 360 aa, Streptococcus pneumoniae
MLIGIPKEIKNNENRVALTPAGVHSLVSRGHRVLIETNAGLGSGFTDADYQKQGAEIVATAGEAWAAELVVKVKESLSSEYGYLRDDLLLFTYLHMAAAPELADAMLTAKTTETVRDNQGQLPLLVPMSEVAGRMAVQIGAHFLTKQAGGSGVLLGGVPGVPKGKVTIIGGGVVGTHAARIALGLGAQVTILDISSKRLSVLEEVFGSQIQTLMSNSFNIEASVRDADVVIGAILIPGAKAPELVTDEMVKQMRPGSVSLTLLLTKVALSKQLTVQRTMNPSMKNTVFSTMPLPISLVRLLALQPSPPMSLFLISKLWLAKDSHKQSLKMKACVKVLLIKVTLTYQLLKDLIVTTLISMI

SEQ ID NO: 189 - protein, 839 aa, Streptococcus pneumoniae
MKINKKYLAGSVAVLALSVCSYELGRHQAGQVKKESNRVSYIDGDQAGQKAENLTPDEVSKREGINAEQIVIKITDQGYVTSHGDHYHYYNGKVPYDAIISEELLMKDPNYQLKDSDIVNEIKGGYVIKVDGKYYVYLKDAAHADNIRTKEEIKRQKQEHSHNHGGGSNDQAVVAARAQGRYTTDDGYIFNASDIIEDTGDAYIVPHGDHYHYIPKNELSASELAAAEAYWNGKQGSRPSSSSSYNANPAQPRLSENHNLTVTPTYHQNQGENISSLLRELYAKPLSERHVESDGLIFDPAQITSRTARGVAVPHGNHYHFIPYEQMSELEKRIARIIPLRYRSNHWVPDSRPEQPSPQSTPEPSPSPQPAPNPQPAPSNPIDEKLVKEAVRKVGDGYVFEENGVSRYIPAKDLSAETAAGIDSKLAKQESLSHKLGAKKTDLPSSDREFYNKAYDLLARIHQDLLDNKGRQVDFEALDNLLERLKDVPSDKVKLVDDILAFLAPIRHPERLGKPNAQITYTDDEIQVAKLAGKYTTEDGYIFDPRDITSDEGDAYVTPHMTHSHWIKKDSLSEAERAAAQAYAKEKGLTPPSTDHQDSGNTEAKGAEAIYNRVKAAKKVPLDRMPYNLQYTVEVKNGSLIIPHYDHYHNIKFEWFDEGLYEAPKGYTLEDLLATVKYYVEHPNERPHSDNGFGNASDHVRKNKVDQDSKPDEDKEHDEVSEPTHPESDEKENHAGLNPSADNLYKPSTDTEETEEEAEDTTDEAEIPQVENSVINAKIADAEALLEKVTDPSIRQNAMETLTGLKSSLLLGTKDNNTISAEVDSLLALLKESQPAPIQ

SEQ ID NO: 190 - protein, 1039 aa, Streptococcus pneumoniae
MKFSKKYIAAGSAVIVSLSLCAYALNQHRSQENKDNNRVSYVDGSQSSQKSENLTPDQVSQKEGIQAEQIVIKITDQGYVTSHGDHYHYYNGKVPYDALFSEELLMKDPNYQLKDADIVNEVKGGYIIKVDGKYYVYLKDAAHADNVRTKDEINRQKQEHVKDNEKVNSNVAVARSQGRYTTNDGYVFNPADIIEDTGNAYIVPHGGHYHYIPKSDLSASELAAAKAHLAGKNMQPSQLSYSSTASDNNTQSVAKGSTSKPANKSENLQSLLKELYDSPSAQRYSESDGLVFDPAKIISRTPNGVAIPHGDHYHFIPYSKLSALEEKIARMVPISGTGSTVSTNAKPNEVVSSLGSLSSNPSSLTTSKELSSASDGYIFNPKDIVEETATAYIVRHGDHFHYIPKSNQIGQPTLPNNSLATPSPSLPINPGTSHEKHEEDGYGFDANRIIAEDESGFVMSHGDHNHYFFKKDLTEEQIKAAQKHLEEVKTSHNGLDSLSSHEQDYPSNAKEMKDLDKKIEEKIAGIMKQYGVKRESIVVNKEKNAIIYPHGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENLKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDLIA

SEQ ID NO: 191 - protein, 477 aa, Streptococcus pneumoniae
MKILFVAAEGAPFSKTGGLGDVIGALPKSLVKAGHEVAVILPYYDMVEAKFGNQIEDVLHFEVSVGWRRQYCGIKKTVLNGVTFYFIDNQYYFFRGHVYGDFDDGERFAFFQLAAIEAMERIDFIPDLLHVHDYHTAMIPFLLKEKYRWIQAYEDIETVLTIHNLEFQGQFSEGMLGDLFGVGFERYADGTLRWNNCLNWMKAGILYANRVSTVSPSYAHEIMTSQFGCNLDQILKMESGKVSGIVNGIDADLYNPQTDALLDYHFNQEDLSGKAKNKAKLQERVGLPVRADVPLVGIVSRLTRQKGFDVVVESLHHILQEDVQIVLLGTGDPAFEGAFSWFAQIYPDKLSTNITFDVKLAQEIYAACDLFLMPSRFEPCGLSQMMAMRYGTLPLVHEVGGLRDTVRAFNPIEGSGTGFSFDNLSPYWLNWTFQTALDLYRNHPDIWRNLQKQAMESDFSWDTACKSYLDLYHSLVN

SEQ ID NO: 192 - protein, 2004 aa, Streptococcus pneumoniae
MEKYFGEKQERFSFRKLSVGLVSATISSLFFMSVLASSSVDAQETAGVHYKYVADSELSSEEKKQLVYDIPTYVENDDETYYLVYKLNSQNQLAELPNTGSKNERQALVAGASLAAMGILIFAVSKKKVKNKTVLHLVLVAGIGNGVLVSVHALENHLLLNYNTDYELTSGEKLPLPKEISGYTYIGYIKEGKTTSESEVSNQKSSVATPTKQQKVDYNVTPNFVDHPSTVQAIQEQTPVSSTKPTEVQVVEKPFSTELINPRKEEKQSSDSQEQLAEHKNLETKKEEKISPKEKTGVNTLNPQDEVLSGQLNKPELLYREETMETKIDFQEEIQENPDLAEGTVRVKQEGKLGKKVEIVRIFSVNKEEVSREIVSTSTTAPSPRIVEKGTKKTQVIKEQPETGVEHKDVQSGAIVEPAIQPELPEAVVSDKGEPEVQPTLPEAVVTDKGETEVQPESPDTVVSDKGEPEQVAPLPEYKGNIEQVKPETPVEKTKEQGPEKTEEVPVKPTEETPVNPNEGTTEGTSIQEAENPVQPAEESTTNSEKVSPDTSSKNTGEVSSNPSDSTTSVGESNKPEHNDSKNENSEKTVEEVPVNPNEGTVEGTSNQETEKPVQPAEETQTNSGKIANENTGEVSNKPSDSKPPVEESNQPEKNGTATKPENSGNTTSENGQTEPEPSNGNSTEDVSTESNTSNSNGNEEIKQENELDPDKKVEEPEKTLELRNVSDLELYSLSNGTYKQHISLEQVPSNPNSYFVKVKSSSFKDVYLPVASISEERKNDKILYKITAKVEKLQQEIESRYKDNFTFYLAKKGTEETTNFTSFSNLVKAINQNPSGTYHLAASLNANEVELGPDERSYIKDTFTGRLIGEKDGKNYAIYNLKKPLFENLSGATVEKLSLKNVAISGKDDIGSLANEAQNNTKIKQVHVDGVLAGERGIGGLLAKAEQSSITESSFKGRIINTYETTAAYNIGGMVGHLTGDKALLTKSKATVAISSNTNTSDQTVGGLAGLVDRDAQIQDSYAEGDINNVKHFGRVAGVAGNLWDRTSGDVRHAGSLTNVLSDVNVTNGNAITGYHYNEMKVKDTFSSKANRVYNVTLVKDEVVSKESFEERGTMLDASQIASKKAEINPLILPTVEPLSTSGKKDSDFSKVAYYQAKRNLTYKNIEKLLPFYNKATIVKYGNLVNENSLLYQKELLSAVMMKDNQVITDIVSNKQTANKLLLHYKDDLSEKLDLKYQNDFAKLAEYSLGNTGLLYTPNQFLYDQTSIIKQVLPDLQKVDYHSEAIRKTLGISPNVKQTELYLEDQFAKTKQQLEDSLKKLLSADAGLASANPVTEGYLVDKIKRNKEALLLGLTYLERWYNFSYGQVNVKDLVLYHLDFFGKGNASPLDTLIELGKSGFNNLLAKNNVDTYGISLASQHGTTDLFSTLEHYRKVFLPNTSNNDWFKSETKAYIVEEKSTIEEVKTKQGLAGTKYSIGVYDRITSATWKYRNMVLPLLTLPERSVFVISTMSSLGFGAYDRYRSSDHKAGKALNDFVEENARETAKRQRDHYDYWYRILDDNAREKLYRNILLYDAYKFGDDNTVGKATEVADFDNPNPAMQHFFGPVGNKVGHNQHGAYATGDAVYYMGYRMLDKDGAITYTHEMTHDSDQDIYLGGYGRRSGLGPEFFAKGLLQAPDHPDDATITINSILKHSKSDSTESRRLQVLDPTTRFNNADDLKQYVHNMFDVVYMLEYLEGNSILKLDTNQKQQLLRKVTNEYHPDPDGNKVYATNVVRNLTVEEVERLRSFNDLIDNNILSSREYASGKYERNGYFTIKLFAPIYAALSNDIGTPGDLMGRRIAYELLAAKGFKDGMVPYISNQYEEEAKQKGKTINLYGKTRGLVTDDLVLEKVFNNQYHTWSEFKKAMYQERQDQFDRLNKVTFNDTTQPWQTFAKKTTSSVDELQKLMDVAVRKDAEHNYYHWNNYNPDIDSEVHKLKRAIFKAYLDQTNDFRSSIFENKK

SEQ ID NO: 193 - protein, 819 aa, Streptococcus pneumoniae
MKINKKYLAGSVAVLALSVCSYELGRYQAGQDKKESNRVAYIDGDQAGQKAENLTPDEVSKREGINAEQIVIKITDQGYVTSHGDHYHYYNGKVPYDAIISEELLMKDPNYQLKDSDIVNEIKGGYVIKVNGKYYVYLKDAAHADNIRTKEEIKRQKQERSHNHNSRADNAVAAARAQGRYTTDDGYIFNASDIIEDTGDAYIVPHGDHYHYIPKNELSASELAAAEAYWNGKQGSRPSSSSSYNANPAQPRLSENHNLTVTPTYHQNQGENISSLLRELYAKPLSERHVESDGLIFDPAQITSRTARGVAVPHGNHYHFIPYEQMSELEKRIARIIPLRYRSNHWVPDSRPEEPSPQPTPEPSPSPQPAPSNPIDEKLVKEAVRKVGDGYVFEENGVSRYIPAKDLSAETAAGIDSKLAKQESLSHKLGTKKTDLPSSDREFYNKAYDLLARIHQDLLDNKGRQVDFEALDNLLERLKDVSSDKVKLVEDILAFLAPIRHPERLGKPNAQITYTDDEIQVAKLAGKYTTEDGYIFDPRDITSDEGDAYVTPHMTHSHWIKKDSLSEAERAAAQAYAKEKGLTPPSTDHQDSGNTEAKGAEAIYNRVKAAKKVPLDRMPYNLQYTVEVKNGSLIIPHYDHYHNIKFEWFDEGLYEAPKGYTLEDLLATVKYYVEHPNERPHSDNGFGNASDHVQRNKNGQADTNQTEKPSEEKPQTEKPEEETPREEKPQSEKPESPKPTEEPEESPEESEEPQVETEKVEEKLREAEDLLGKIQDPIIKSNAKETLTGLKNNLLFGTQDNNTIMAEAEKLLALLKESK

SEQ ID NO: 194 - protein, 802 aa, Streptococcus pneumoniae
LILSVCSYELGLYQARTVKENNRVSYIDGKQATQKTENLTPDEVSKREGINAEQIVIKITDQGYVTSHGDHYHYYNGKVPYDAIISEELLMKDPNYKLKDEDIVNEVKGGYVIKVDGKYYVYLKDAAHADNVRTKEEINRQKQEHSQHREGGTPRNDGAVALARSQGRYTTDDGYIFNASDIIEDTGDAYIVPHGDHYHYIPKNELSASELAAAEAFLSGRGNLSNSRTYRRQNSDNTSRTNWVPSVSNPGTTNTNTSNNSNTNSQASQSNDIDSLLKQLYKLPLSQRHVESDGLVFDPAQITSRTARGVAVPHGDHYHFIPYSQMSELEERIARIIPLRYRSNHWVPDSRPEQPSPQPTPEPSPGPQPAPNLKIDSNSSLVSQLVRKVGEGYVFEEKGISRYVFAKDLPSETVKNLESKLSKQESVSHTLTAKKENVAPRDQEFYDKAYNLLTEAHKALFENKGRNSDFQALDKLLERLNDESTNKEKLVDDLLAFLAPITHPERLGKPNSQIEYTEDEVRIAQLADKYTTSDGYIFDEHDIISDEGDAYVTPHMGHSHWIGKDSLSDKEKVAAQAYTKEKGILPPSPDADVKANPTGDSAAAIYNRVKGEKRIPLVRLPYMVEHTVEVKNGNLIIPHKDHYHNIKFAWFDDHTYKAPNGYTLEDLFATIKYYVEHPDERPHSNDGWGNASEHVLGKKDHSEDPNKNFKADEEPVEETPAEPEVPQVETEKVEAQLKEAEVLLAKVTDSSLKANATETLAGLRNNLTLQIMDNNSIMAEAEKLLALLKGSNPSSVSKEKIN

SEQ ID NO: 195 - protein, 1084 aa, Streptococcus pneumoniae
MPVEIKTTKEIHPKIYAYTTPTVTSNEGWIKIGYTERDVTQRIKEQTHTAHIATDVLWTGDAAYTEEPDKGKTFKDHDFHHFLSFHDVERRPKTEWFYFNGTPEKSKNLFDKFVQHDLSGYQPGKGQDYTLRQEQEEAVAKTLAYFQEHAGGKFLWNAKPRFGKTLSTYDLARRMEAVNVLIVTNRPAIANSWYDDFETFIAGQTTYKFVSESDSLKSRPILSRQEFLGILADDVRQLAFISLQDLKGSVYLGGEHDKLKWVTDLHWDLLVIDEAHEGVDTFKTDQAFNKIRRNFTLHLSGTSFKALAKGDFTEEQIYNWSYADEQAAKYSWSLEQEEENPYESLPQLNLFTYQMSQMIGEKLEKGAQIDGENIDYVFDLSEFFATDDKGKFIHEHDVRNWLDTLSSNEKYPFSTKELRNELKHTFWLLERVASAKALKALLEEHPIYENYEIVLAAGDGRMSEEDDKVKLKSLDLVRKAIAENDKTITLSVGQLTTGVTIPEWTGVLMLSNLKSPALYMQAAFRAQNPYSWSDNKGNHFRKERAYVFDFAPERTLILFDEFANNLLLVTAAGRGTSATREENIRELLNFFPIIAEDRAGKMVEIDAKAVLTTPRQIKAREVLKRGFMSNLLFDNISGIFQASQTVLDILNELPVEKEGKVQDSSDLLDFSDVTVDDEGNAVVDHEIVVNQQMRLFGEKVYGLGESVAELVTKDEERTQKQLVNDLSKTVSSVIVEELKADYSLKTRETEQIKKQITATLENEIRKNDIERKISEAHIKQELQQQLKEANDKAQKDKIQEDLEKRLEENKLIHKEKLEQTLKKEVEKMPEKFIEQVEIKRVEQLKQSAQDEIRDHLRGFARTIPSFIMAYGDQTLTLDNFDAFVPEHVFYEVTGITIDQFRYLRDGGQDFAGHLFDKATFDEAIQEFLRKKKELADYFKDQKEDIFDYIPPQKTNQIFTPKRVVKRMVDDLEKENPGIFDDPSKTFIDLYMKSGLYIAELVKRLYNSNGLKEAFPNPEERLKHILEKQVYGFAPSEIIYNISTNFIFGNLSKDISRKNFVLADTIPAAKEGSIQKLVDSYFENN

SEQ ID NO: 196 - protein, 234 aa, Streptococcus pneumoniae
MKKILIVDDEKPISDIIKFNMTKEGYEVVTAFNGREALEQFEAEQPDIIILDLMLPEIDGLEVAKTIRKTSSVPILMLSAKDSEFDKVIGLELGADDYVTKPFSNRELQARVKALLRRSQPMPVDGQEADSKPQPIQIGDLEIVPDAYVAKKYGEELDLTHREFELLYHLASHTGQVITREHLLETVWGYDYFGDVRTVDVTVRRLREKIEDTPSRPEYILTRRGVGYYMRNNA

SEQ ID NO: 197 - protein, 721 aa, Streptococcus pneumoniae
MKKKFLAFLLILFPIFSLGIAKAETIKIVSDTAYAPFEFKDSDQTYKGIDVDIINKVAEIKGWNIQMSYPGFDAAVNAVQAGQADAIMAGMTKTKEREKVFTMSDTYYDTKVVIATTKSHKISKYDQLTGKTVGVKNGTAAQRFLETIKDKYGFTIKTFDTGDLMNNSLSAGAIDAMMDDKPVIEYAINQGQDLHIEMDGEAVGSFAFGVKKGSKYEHLVTEFNQALSEMKKDGSLDKIIKKWTASSSSAVPTTTTLAGLKAIPVKAKYIIASDSSFAPFVFQNSSNQYTGIDMELIKAIAKDQGFEIEITNPGFDAAISAVQAGQADGIIAGMSVTDARKATFDFSESYYTANTILGVKESSNIASYEDLKGKTVGVKNGTASQTFLTENQSKYGYKIKTFADGSSMYDSLNTGAIDAVMDDEPVLKYSISQGQKLKTPISGTPIGETAFAVKKGANPELIEMFNNGLANLKANGEFQKILDKYLASESSTASTSTVDETTLWGLLQNNYKQLLSGLGITLALALISFAIAIVIGIIFGMFSVSPYKSLRVISEIFVDVIRGIPLMILAAFIFWGIPNFIESITGQQSPINDFVAGTIALSLNAAAYIAEIVRGGIQAVPVGQMEASRSLGISYGKTMRKIILPQATKLMLPNFVNQFVIALKDTTIVSAIGLVELFQTGKIIIARNYQSFKMYAILAIFYLVIITLLTRLAKRLEKRIR

SEQ ID NO: 198 - protein, 523 aa, Streptococcus pneumoniae
MAFESLTERLQNVFKNLRKKGKISESDVQEATKEIRLALLEADVALPVVKDFIKKVRERAVGHEVIDTLNPAQQIIKIVDEELTAVLGSDTAEIIKSPKIPTIIMMVGLQGAGKTTFAGKLANKLKKEENARPLMIAADIYRPAAIDQLKTLGQQIDVPVFALGTEVPAVEIVRQGLEQAQTNHNDYVLIDTAGRLQIDELLMNELRDVKALAQPNEILLVVDAMIGQEAANVAREFNAQLEVTGVILTKIDGDTRGGAALSVRHITGKPIKFTGTGEKITDIETFHPDRMSSRILGMGDMLTLIEKASQEYDEQKALEMAEKMRENTFDFNDFIDQLDQVQNMGPMEDLLKMIPGMANNPALQNMKVDERQIARKRAIVSSMTPEERENPDLLNPSRRRRIAAGSGNTFVEVNKFIKDFNQAKQLMQGVMSGDMNKMMKQMGINPNNLPKNMPNMGGMDMSALEGMMGQGGMPDLSALGGAGMPDMSQMFGGGLKGKIGEFAMKQSMKRMANKMKKAKKKRK

SEQ ID NO: 199 - protein, 233 aa, Streptococcus pneumoniae
MSQIWTKEKFISQVQGGVIVSCQALPGEALYNEEFSLMPFMAKAALEAGAVGIRANSVRDIKAIQKVVDLPIIGIIKRDYPPQEPYITATMKEVDELVECGTTVIAFDATLRPRYDGLVVSEFIKKIKEKYPNQLLMADVSNLDEGLYAFKSGVDFVGTTLSGYTSTSVQSDEPDFELMKKLADFNIPVIAEGKIHYPEQLKKAYSLGVTSVVIGGAITRPKEIAQRFINVIK

SEQ ID NO: 200 - protein, 388 aa, Streptococcus pneumoniae
MRYLTAGESHGPRLTAIIEGIPAGLPLTAEDINEDLRRRQGGYGRGGRMKIENDQVVFTSGVRHGKTTGAPITMDVINKDHQKWLDIMSAEDIEDRLKSKRKITHPRPGHADLVGGIKYRFDDLRNSLERSSARETTMRVAVGAVAKRLLAELDMEIANHVVVFGGKEIDVPENLTVAEIKQRAAQSEVSIVNQEREQEIKDYIDQIKRDGDTIGGVVETVVGGVPVGLGSYVQWDRKLDARLAQAVVSINAFKGVEFGLGFEAGYRKGSQVMDEILWSKEDGYTRRTNNLGGFEGGMTNGQPIVVRGVMKPIPTLYKPLMSVDIETHEPYKATVERSDPTALPAAGMVMEAVVATVLAQEILEKFSSDNLEELKEAVAKHRDYTKNY

SEQ ID NO: 201 - protein, 390 aa, Streptococcus pneumoniae
MVVMNRIRVSKRVEKKLAKGLVLLEASDLENVNLKDQEVEVQGQEGNFLGTAYLSQQNKGLGWFISKDKVAFNQAFFETLFRKAKEKRNAYYQDDLTTAFRLFNQEGDGFGGLTVDLYGDYAVFSWYNSYVYQIRQTISEAFRQVFPEVLGAYEKIRFKGLDYESAHVYGQEAPDFFNVLENGVLYQVFMNDGLMTGIFLDQHEVRGSLVDGLAMGKSLLNMFSYTAAFSVAAAMGGASHTTSVDLAKRSRELSQAHFQANGLSTDEHRFIVMDVFEYFKYAKRKDLTYDVIVLDPPSFARNKKQTFSVAKDYHKLISQSLEILNPGGIIIASTNAANVSRQKFTEQIDKGFAGRSYQILNKYGLPADFAYNKKDESSNYLKVISMKVSK

SEQ ID NO: 202 - protein, 428 aa, Streptococcus pneumoniae
MTKTLKRPEVLSPAGTLEKLKVAVQYGADAVFIGGQAYGLRSRAGNFTFEQMEEGVQFAAKYGAKVYVAANMVMHEGNEAGAGEWFRKLRDIGIAAVIVSDPALIMIAVTEAPGLEIHLSTQASATNYETLEFWKELGLTRVVLAREVSMEELAEIRKRTDVEIEAFVHGAMCISYSGRCTLSNHMSMRDANRGGCSQSCRWKYDLYDMPFGKERKSLQGEIPEEFSMSAVDMSMIDHIPDMIENGVDSLKIEGRMKSIHYVSTVTNCYKAAVDAYLESPEKFEAIKQDLVDEMWKVAQRELATGFYYGTPSENEQLFGARRKIPEYKFVAEVVSYDDAAQTATIRQRNVINEGDQVEFYGPGFRHFETYIEDLHDAKGNKIDRAPNPMELLTIKVPQPVQSGDMVRALKEGLINLYKEDGTSVTVRA

SEQ ID NO: 203 - protein, 280 aa, Streptococcus pneumoniae
MNTYQLNNGVEIPVLGFGTFKAKDGEEAYRAVLEALKAGYRHIDTAAIYQNEESVGQAIKDSGVPREEMFVTTKLWNSQQTYEQTRQALEKSIEKLGLDYLDLYLIHWPNPKPLRENDAWKTRNAEVWRAMEDLYQEGKIRAIGVSNFLPHHLDALLETATIVPAVNQVRLAPGVYQDQVVAYCREKGILLEAWGPFGQGELFDSKQVQEIAANHGKSVAQIALAWSLAEGFLPLPKSVTTSRIQANLDCFGIELSHEERETLKTIAVQSGAPRVDDVDF

SEQ ID NO: 204 - protein, 551 aa, Streptococcus pneumoniae
LSEKSREEEKLSFKEQILRDLEKVKGYDEVLKEDEAVVRTPANEPSTEELMADSLSTVEEIMRKAPTVPTHPSQGVPASPADEIQRETPGVPSHPSQDVPSSPAEESGSRPGPGPVRPKKLEREYNETPTRVAVSYTTAEKKAEQAGPETPTPATETVDIIRDTSRRSRREGAKPVKPKKEKKSHVKAFVISFLVFLALLSAGGYFGYQYVLDSLLPIDANSKKYVTVGIPEGSNVQEIGTTLEKAGLVKHGLIFSFYAKYKNYTDLKAGYYNLQKSMSTEDLLKELQKGGTDEPQEPVLATLTIPEGYTLDQIAQAVGQLQGDFKESLTAEAFLAKVQDETFISQAVAKYPTLLESLPVKDSGARYRLEGYLFPATYSIKESTTIESLIDEMLAAMDKNLSPYYSTIKSKNLTVNELLTIASLVEKEGAKTEDRKLIAGVFYNRLNRDMPLQSNIAILYAQGKLGQNISLAEDVAIDTNIDSPYNVYKNVGLMPGPVDSPSLDAIESSINQTKSDNLYFVADVTEGKVYYANNQEDHDRNVAEHVNSKLN

SEQ ID NO: 205 - protein, 205 aa, Streptococcus pneumoniae
MKQERFPLVSDDEVMLTEMPVMNLYDESDLISNIKGEYRDKNYLEWAPIAEEKPVKPIEKQVEKPKKAPLGVKKEGKSYAEVAREEARADLKKKRSANYLTQDFSLARRHSQPSLVRQGNQPTAPFQKENPGEFVKYSQKLTQSHYILAEEVHSIPTKNEEVSAPAPKKNNYDFLKKSQIYNKKSKQTEQERRVAQELNLTRMTE

SEQ ID NO: 206 - protein, 652 aa, Streptococcus pneumoniae
MKKSKSKYLTLAGLVLGTGVLLSACGNSSTASKTYNYVYSSDPSSLNYLAENRAATSDIVANLVDGLLENDQYGNIIPSLAEDWTVSQDGLTYTYKLRKDAKWFTSEGEEYAPVTAQDFVTGLQYAADKKSEALYLVQDSVAGLDDYITGKTSDFSTVGVKALDDQTVQYTLVKPELYWNSKTLATILFPVNADFLKSKGDDFGKADPSSILYNGPFLMKALVSKSAIEYKKNPNYWDAKNVFVDDVKLTYYDGSDQESLERNFTAGAYTTARLFPNSSSYEGIKEKYKNNIIYSMQNSTSYFFNFNLDRKSYNYTSKTSDIEKKSTQEAVLNKNFRQAINFAFDRTSYGAQSEGKEGATKILRNLVVPPNFVSIKGKDFGEVVASKMVNYGKEWQGINFADGQDPYYNPEKAKAKFAEAKKELEAKGVQFPIHLDKTVEVTDKVGIQGVSSIKQSIESVLGSDNVVIDIQQLTSDEFDSSGYFAQTAAQKDYDLYHGGWGPDYQDPSTYLDIFNTNSGGFLQNLGLEPGEANDKAKAVGLDVYTQMLEEANKEQDPAKRYEKYADIQAWLIDSSLVLPSVSRGGTPSLRRTVPFAAAYGLTGTKGVESYKYLKVQDKIVTTDEYAKAREKWLKEKEESNKKAQEELAKHVK

SEQ ID NO: 207 - protein, 506 aa, Streptococcus pneumoniae
VEQHSDVCYIFYRRERLKTKIGLASICLLGLATSHVAANETEVAKTSQDTTTASSSSEQNQSSNKTQTSAEVQTNAAAHWDGDYYVKDDGSKAQSEWIFDNYYKAWFYINSDGRYSQNEWHGNYYLKSGGYMAQNEWIYDSNYKSWFYLKSDGAYAHQEWQLIGNKWYYFKKWGYMAKSQWQGSYFLNGQGAMMQNEWLYDPAYSAYFYLKSDGTYANQEWQKVGGKWYYFKKWGYMARNEWQGNYYLTGSGAMATDEVIMDGTRYIFAASGELKEKKDLNVGWVHRDGKRYFFNNREEQVGTEHAKKVIDISEHNGRINDWKKVIDENEVDGVIVRLGYSGKEDKELAHNIKELNRLGIPYGVYLYTYAENETDAESDAKQTIELIKKYNMNLSYPIYYDVENWEYVNKSKRAPSDTGTWVKIINKYMDTMKQAGYQNVYVYSYRSLLQTRLKHPDILKHVNWVAAYTNALEWENPHYSGKKGWQYTSSEYMKGIQGRVDVSVWY

SEQ ID NO: 208 - protein, 158 aa, Streptococcus pneumoniae
MAKEPWQEDIYDQEESRAERRHRNHGGADRMANRILTILASIFFVIVVVMVIVLIYLSSGGSNRTAALKGFHDSDASVVQISSSSSSQPEQSSEPESTSSSSEEAANPEGTIKVLAGEGEAAIAARAGISIAQLEALNPGHMATGSWFANPGDVIKIK

SEQ ID NO: 209 - protein, 262 aa, Streptococcus pneumoniae
MPITSLEIKDKTFGTRFRGFDPEEVDEFLDIVVRDYEDLVRANHDKNLRIKSLEERLSYFDEIKDSLSQSVLIAQDTAERVKQAAHERSNNIIHQAEQDAQRLLEEAKYKANEILRQATDNAKKVAVETEELKNKSRVFHQRLKSTIESQLAIVESSDWEDILRPTATYLQTSDEAFKEVVSEVLGEPIPAPIEEEPIDMTRQFSQAEMAELQARIEVADKELSEFEAQIKQEVEAPTPVVSPQVEEEPLLIQLAQCMKNQK

SEQ ID NO: 210 - protein, 179 aa, Streptococcus pneumoniae
MSLKDRFDRFIDYFTEDEDSSLPYEKRDEPVFTSVNSSQEPALPMNQPSQSAGTKENNITRLHARQQELANQSQRATDKVIIDVRYPRKYEDATEIVDLLAGNESILIDFQYMTEVQARRCLDYLDGACHVLAGNLKKVASTMYLLTPVNVIVNVEDIRLPDEDQQGEFGFDMKRNRVR

SEQ ID NO: 211 - protein, 305 aa, Streptococcus pneumoniae
MSDLKKYEGVIPAFYACYDDQGEVSPERTRALVQYFIDKGVQGLYVNGSSGECIYQSVEDRKLILEEVMAVAKGKLTIIAHVACNNTKDSMELARHAESLGVDAIATIPPIYFRLPEYSVAKYWNDISSAAPNTDYVIYNIPQLAGVALTPSLYTEMLKNPRVIGVKNSSMPVQDIQTFVSLGGEDHIVFNGPDEQFLGGRLMGARAGIGGTYGAMPELFLKLNQLIADKDLETARELQYAINAIIGKLTSAHGNMYGVIKEVLKINEGLNIGSVRSPLTPVTEEDRPVVEAAAALIRETKERFL

SEQ ID NO: 212 - protein, 697 aa, Streptococcus pneumoniae
MNKRGLYSKLGISVVGISLLMGVPTLIHANELNYGQLSISPIFQGGSYQLNNKSIDISSLLLDKLSGESQTVVMKFKADKPNSLQALFGLSNSKAGFKNNYFSIFMRDSGEIGVEIRDAQKGINYLFSRPASLWGKHKGQAVENTLVFVSDSKDKTYTMYVNGIEVFSETVDTFLPISNINGIDKATLGAVNREGKEHYLAKGSIDEISLFNKAISDQEVSTIPLSNPFQLIFQSGDSTQANYFRIPTLYTLSSGRVLSSIDARYGGTHDSKSKINIATSYSDDNGKTWSEPIFAMKFNDYEEQLVYWPRDNKLKNSQISGSASFIDSSIVEDKKSGKTILLADVMPAGIGNNNANKADSGFKEINGHYYLKLKKNGDNDFRYTVRENGVVYNETTNKPTNYTINDKYEVLEGGKSLTVEQYSVDFDSGSLRERHNGKQVPMNVFYKDSLFKVTPTNYIAMTTSQNRGESWEQFKLLPPFLGEKHNGTYLCPGQGLALKSSNRLIFATYTSGELTYLISDDSGQTWKKSSASIPFKNATAEAQMVELRDGVIRTFFRTTTGKIAYMTSRDSGETWSKVSYIDGIQQTSYGTQVSAIKYSQLIDGKEAVILSTPNSRSGRKGGQLVVGLVNKEDDSIDWKYHYDIDLPSYGYAYSAITELPNHHIGVLFEKYDSWSRNELHLSNVVQYIDLEINDLTK

SEQ ID NO: 213 - protein, 946 aa, Streptococcus pneumoniae
MNRSVQERKCRYSIRKLSVGAVSMIVGAVVFGTSPVLAQEGASEQPLANETQLSGESSTLTDTEKSQPSSETELSGNKQEQERKDKQEEKIPRDYYARDLENVETVIEKEDVETNASNGQRVDLSSELDKLKKLENATVHMEFKPDAKAPAFYNLFSVSSATKKDEYFTMAVYNNTATLEGRGSDGKQFYNNYNDAPLKVKPGQWNSVTFTVEKPTAELPKGRVRLYVNGVLSRTSLRSGNFIKDMPDVTHVQIGATKRANNTVWGSNLQIRNLTVYNRALTPEEVQKRSQLFKRSDLEKKLPEGAALTEKTDIFESGRNGNPNKDGIKSYRIPALLKTDKGTLIAGADERRLHSSDWGDIGMVIRRSEDNGKTWGDRVTITNLRDNPKASDPSIGSPVNIDMVLVQDPETKRIFSIYDMFPEGKGIFGMSSQKEEAYKKIDGKTYQILYREGEKGAYTIRENGTVYTPDGKATDYRVVVDPVKPAYSDKGDLYKGDQLLGNIYFTTNKTSPFRIAKDSYLWMSYSDDDGKTWSAPQDITPMVKADWMKFLGVGPGTGIVLRNGPHKGRILIPVYTTNNVSHLDGSQSSRVIYSDDHGKTWHAGEAVNDNRQVDGQKIHSSTMNNRRAQNTESTVVQLNNGDVKLFMRGLTGDLQVATSKDGGVTWEKDIKRYPQVKDVYVQMSAIHTMHEGKEYIILSNAGGPKRENGMVHLARVEENGELTWLKHNPIQKGEFAYNSLQELGNGEYGILYEHTEKGQNAYTLSFRKFNWEFLSKNLISPTEANRDGQRRDGQRSYWLGVRLRSIGQQGSNPSIGKWNSDFPNPVQDLVVCSRGRYRTGNYWYSRKHRKYASSCKSSRCQSSWRSKWQSSGASSRIYRGSWYRASCSNRRVGIFACNSYYKKRLYLQSSSCSAGTSNRKQGEPPSFTRTNSFLPWSVYAREKERT

SEQ ID NO: 214 - protein, 659 aa, Streptococcus pneumoniae
MIQIGKIFAGRYRIVKQIGRGGMADVYLAKDLILDGEEVAVKVLRTNYQTDPIAVARFQREARAMADLDHPHIVRITDIGEEDGQQYLAMEYVAGLDLKRYIKEHYPLSNEEAVRIMGQILLAMRLAHTRGIVHRDLKPQNILLTPDGTAKVTDFGIAVAFAETSLTQTNSMLGSVHYLSPEQARGSKATVQSDIYAMGIIFYEMLTGHIPYDGDSAVTIALQHFQKPLPSVIAENPSVPQALENVIIKATAKKLTNRYRSVSEMYVDLSSSLSYNRRNESKLIFDETSKADTKTLPKVSQSTLTSIPKVQAQTEHKSIKNPSQAVTEETYQPQAPKKHRFKMRYLILLASLVLVAASLIWILSRTPATIAIPDVAGQTVAEAKATLKKANFEIGEEKTEASEKVEEGRIIRTDPGAGTGRKEGTKINLVVSSGKQSFQISNYVGRKSSDVIAELKEKKVPDNLIKIEEEESNESEAGTVLKQSLPEGTTYDLSKATQIVLTVAKKATTIQLGNYIGRNSTEVISELKQKKVPENLIKIEEEESSESEPGTIMKQSPGAGTTYDVSKPTQIVLTVAKKVTSVAMPSYIGSSLEFTKNNLIQIVGIKEANIEVVEVTTAPAGSAEGMVVEQSPRAGEKVDLNKTRVKISIYKPKTTSATP

SEQ ID NO: 215 - protein, 311 aa, Streptococcus pneumoniae
MTKLIFMGTPDFSATVLKGLLTDDRYEILAVVTQPDRAVGRKKVIQETPVKQAAKEAGLSIYQPEKLSGSPEMEDLMKLGADGIVTAAFGQFLPSKLLDSMDFAVNVHASLLPRHRGGAPIHYALIQGDEEAGVTIMEMVKEMDAGDMISRRSIPITDEDNVGTLFEKLALVGRDLLLDTLPAYIAGDIKPEPQDTSQVTFSPNIKPEEEKLDWNKTNRQLFNQIRGMNPWPVAHTFLKGDRFKIYEALPVEGQGNPGEILSIGKKELIVATAEGALSLKQVQPAGKPKMDIASFLNGVGRTLTVGERFGD

SEQ ID NO: 216 - protein, 790 aa, Streptococcus pneumoniae
VFRRLGQDFQLRKVKKILKQINALKGKMSSLSDQELVAKTVEFRQRLSEGESLDDILVEAFAVVREADKRILGMFPYDVQVMGAIVMHYGNVAEMNTGEGKTLTATMPVYLNAFSGEGVMVVTPNEYLSKRDAEEMGQVYRFLGLTIGVPFTEDPKKEMKAEEKKLIYASDIIYTTNSNLGFDYLNDNLASNEEGKFLRPFNYVIIDEIDDILLDSAQTPLIIAGSPRVQSNYYAIIDTLVTTLVEGEDYIFKEEKEEVWLTTKGAKSAENFLGIDNLYKEEHASFARHLVYAIRAHKLFTKDKDYIIRGNEMVLVDKGTGRLMEMTKLQGGLHQAIEAKEHVKLSPETRAMASITYQSLFKMFNKISGMTGTGKVAEKEFIETYNMSVVRIPTNRPRQRIDYPDNLYITLPEKVYASLEYIKQYHAKGNPLLVFVGSVEMSQLYSSLLFREGIAHNVLNANNAAREAQIISESGQMGAVTVATSMAGRGTDIKLGKGVAELGGLIVIGTERMESQRIDLQIRGRSGRQGDPGMSKFFVSLEDDVIKKFGPSWVHKKYKDYQVQDMTQPEVLKGRKYRKLVEKAQHASDSAGRSARRQTLEYAESMNIQRDIVYKERNRLIDGSRDLEDVVVDIIERYTEEVAADHYASRELLFHFIVTNISFHVKEVPDYIDVTDKTAVRSFMKQVIDKELSEKKELLNQHDLYEQFLRLSLLKAIDDNWVEQVDYLQQLSMAIGGQSASQKNPIVEYYQEAYAGFEAMKEQIHADMVRNLLMGLVEVTPKGEIVTHFP

SEQ ID NO: 217 - protein, 4776 aa, Streptococcus pneumoniae
MTETVEDKVSHSITGLDILKGIVAAGAVISGTVATQTKVFTNESAVLEKTVEKTDALATNDTVVLGTISTSNSASSTSLSASESASTSASESASTSASTSASTSASESASTSASTSISASSTVVGSQTAAATEATAKKVEEDRKKPASDYVASVTNVNLQSYAKRRKRSVDSIEQLLASIKNAAVFSGNTIVNGAPAINASLNIAKSETKVYTGEGVDSVYRVPIYYKLKVTNDGSKLTFTYTVTYVNPKTNDLGNISSMRPGYSIYNSGTSTQTMLTLGSDLGKPSGVKNYITDKNGRQVLSYNTSTMTTQGSGYTWGNGAQMNGFFAKKGYGLTSSWTVPITGTDTSFTFTPYAARTDRIGINYFNGGGKVVESSTTSQSLSQSKSLSVSASQSASASASTSASASASTSASASASTSASASASTSASVSASTSASASASTSASASASTSASESASTSASASASTSASASASTSASASASTSASESASTSASASASTSASESASTSASASASTSASASASTSASGSASTSTSASASTSASASASTSASASASISASESASTSASESASTSTSASASTSASESASTSASASASTSASASASTSASASASTSASASTSASESASTSASASASTSASASASTSASASASTSASASASTSASVSASTSASASASTSASASASTSASESASTSASASASTSASASASTSASASASTSASASASTSASASASTSASESASTSASASASTSASASASTSASASASTSASASASTSASASASISASESASTSASASASTSASASASTSASASASTSASESASTSASASASTSASASASTSASASASTSASASASTSASASASTSASASASTSASESASTSASASASTSASESASTSASASASTSASASASTSASASASTSASASASTSASASASTSASASASTSASASTSASESASTSASASASTSASASASTSASASASTSASESASTSASASASTSASASASTSASASASTSASASASTSASASASISASESASTSASASASTSASVSASTSASASASTSASESASTSASASASTSASESASTSASASASTSASASASISASESASTSASASASTSASASASTSASASASTSASESASTSTSASASTSASESASTSASASASTSASASASTSASASASTSASASASTSASASTSASESASTSASASASTSASASASTSASASASTSASASASTSASASASTSASASASTSASASASTSASASASTSASESASTSASASASTSASASASTSASASASTSASASASTSASVSASTSASESASTSASASASTSASASASTSASESASTSASASASTSASESASTSASASASTSASASASTSASASASTSASASASTSASASASTSASASASTSASASASTSASASASTSASASASTSASASASTSASASASTSASASASTSASASASISASESASTSASASASTSASASASTSASVSASTSASASASTSASASASISASESASTSASASASTSASASASTSASASASTSASASASISASESASTSASASASTSASASASTSASASASTSASASASTSASASASTSASASASTSASASASTSASASASTSASASASTSASESASTSASASASTSASASASTSASASASTSASVSASTSASESASTSASASASTSASASASTSASASASTSASESASTSASASASTSASASASTSASESASTSASASASTSASASASTSASASASTSASASASASTSASASASTSASASASTSASASASISASESASTSASESASTSTSASASTSASESASTSASASASTSASASASTSASASASTSASASTSASESASTSASASASTSASASASTSASASASTSASASASTSASASASTSASVSASTSASASASTSASASASTSASESASTSASASASTSASASASTSASASASTSASASASTSASASASTSASESASTSASASASTSASASASTSASASASTSASASASTSASASASISASESASTSASASASTSASASASTSASASASTSASESASTSASASASTSASASASTSASASASTSASASASTSASASASTSASASASTSASESASTSASASASTSASESASTSASASASTSASASASTSASASASTSASASASTSASASASTSASASASTSASASTSASESASTSASASASTSASASASTSASASASTSASESASTSASASASTSASASASTSASASASTSASASASTSASASASISASESASTSASASASTSASVSASTSASASASTSASESASTSASASASTSASESASTSASASASTSASASASISASESASTSASASASTSASASASTSASASASTSASESASTSTSASASTSASESASTSASASASTSASASASTSASASASTSASASASTSASASTSASESASTSASASASTSASASASTSASASASTSASASASTSASASASTSASASASTSASASASTSASASASTSASASASTSASASASTSASASASTSASESASTSASASASTSASASASTSASASASTSASVSASTSASESASTSASASASTSASASASTSASASASTSASESASTSASASASTSASASASTSASESASTSASASASTSASASASTSASASASTSASASASASTSASASASTSASASASTSASASASISASESASTSASASASASTSASASASTSASASASTSASASASISASESASTSASESASTSTSASASTSASESASTSASASASTSASASASTSASASASTSASASTSASESASTSASASASTSASASASTSASASASTSASASASTSASASASTSASVSASTSASASASTSASASASTSASESASTSASASTSASESASTSASASASTSASASASTSASASASTSASESASTSASASASTSASASASTSASESASTSASASASTSASASASTSASASASTSASESASTSASASASTSASESASTSASASASTSASASASTSASGSASTSTSASASTSASASASTSASASASISASESASTSASESASTSTSASASTSASESASTSASASASTSASASASTSASASASTSASASTSASESASTSASASASTSASASASTSASASASTSASASASTSASVSASTSASASASTSASASASTSASESASTSASASASTSASASASTSASASASTSASASASTSASASASTSASESASTSASASASTSASASASTSASASASTSASASASTSASASASISASESASTSASASASTSASASASTSASASASTSASESASTSASASASTSASASASTSASASASTSASASASTSASASASTSASASASTSASESASTSASASASTSASESASTSASASASTSASASASTSASASASTSASASASTSASASASTSASASASTSASASTSASESASTSASASASTSASASASTSASASASTSASESASTSASASASTSASASASTSASASASTSASASASTSASASASISASESASTSASASASTSASVSASTSASASASTSASESASTSASASASTSASESASTSASASASTSASASASISASESASTSASASASTSASASASTSASASASTSASESASTSTSASASTSASESASTSASASASTSASASASTSASASASTSASASASTSASASTSASESASTSASASASTSASASASTSASASASTSASASASTSASASASTSASASASTSASASASTSASASASTSASESASTSASASASTSASASASTSASASASTSASASASTSASVSASTSASESASTSASASASTSASASASTSASESASTSASASASTSASESASTSASASASTSASASASTSASASASTSASASASTSASASASTSASASASTSASASASTSASASASTSASASASTSASASASTSASASASTSASASASTSASASASISASESASTSASASASTSASASASTSASVSASTSASASASTSASASASISASESASTSASASASTSASASASTSASASASTSASASASISASESASTSASASASTSASASASTSASASASTSASASASTSASASASTSASASASTSASASASTSASASASTSASASASTSASESASTSASASASTSASASASISASESASTSASASASTSASASASTSASASASTSASESASTSTSASASTSASESASTSASASASTSASASASTSASASASTSASASASTSASASTSASESASTSASASASTSASASASTSASASASTSASASASTSASASASTSASASASTSASASASTSASASASTSASESASTSASASASTSASASASTSASASASTSASASASTSASVSASTSASESASTSASASASTSASASASTSASESASTSASASASTSASESASTSASASASTSASASASTSASASASTSASASASTSASASASTSASASASTSASASASTSASASASTSASASASTSASASASTSASASASTSASASASTSASASASISASESASTSASASASTSASASASTSASVSASTSASASASTSASASASISASESASTSASASASTSASASASTSASASASTSASASASISASESASTSASASASTSASASASTSASASASTSASASASTSASASASTSASASASTSASASASTSASASASTSASASASTSASASASTSASASASTSASASASTSASASASTSASASASTSVSNSANHSNSQVGNTSGSTGKSQKELPNTGTESSIGSVLLGVLAAVTGIGLVAKRRKRDEEE

SEQ ID NO: 218 - protein, 202 aa, Streptococcus pneumoniae
MSNEKNTNTNVEKKDATVVAHEIKGELTYEDKVIQKIIGLSLENVSGLLGIDGGFFSNLKEKIVNSDDVTSGVNVEVGKTQVAVDLNVIVEYQKNVPALYSEIREIVSSEVAKMTDLEIVEINVNVVDIKTKEQHEADSVSLQDRVSDVAESTGEFTSEQFEKAKSGLGSGFSTVQEKVSEGVEAVKGAANGVVSHENTRVN

SEQ ID NO: 219 - protein, 355 aa, Streptococcus pneumoniae
MTKEKNVILTARDIVVEFDVRDKVLTAIRGVSLELVEGEVLALVGESGSGKSVLTKTFTGMLEENGRIAQGSIDYRGQDLTALSSHKDWEQIRGAKIATIFQDPMTSLDPIKTIGSQITEVIVKHQGKTAKEAKELAIDYMNKVGIPDADRRFNEYPFQYSGGMRQRIVIAIALACRPDVLICDEPTTALDVTIQAQIIDLLKSLQNEYHFTTIFITHDLGVVASIADKVAVMYAGEIVEYGTVEEVFYDPRHPYTWSLLSSLPQLADDKGDLYSIPGTPPSLYTDLKGDAFALRSDYAMQIDFEQKAPQFSVSETHWAKTWLLHEDAPKVEKPAVIANLHDKIREKMGFAHLAD

SEQ ID NO: 220 - protein, 659 aa, Streptococcus pneumoniae
MKKNRVFATAGLVLLAAGVLAACSSSKSSDSSAPKAYGYVYTADPETLDYLISSKNSTTVVTSNGIDGLFTNDNYGNLAPAVAEDWEVSKDGLTYTYKIRKGVKWFTSDGEEYAEVTAKDFVNGLKHAADKKSEAMYLAENSVKGLADYLSGTSTDFSTVGVKAVDDYTLQYTLNQPEPFWNSKLTYSIFWPLNEEFETSKGSDFAKPTDPTSLLYNGPFLLKGLTAKSSVEFVKNEQYWDKENVHLDTINLAYYDGSDQESLERNFTSGAYSYARLYPTSSNYSKVAEEYKDNIYYTQSGSGIAGLGVNIDRQSYNYTSKTTDSEKVATKKALLNKDFRQALNFALDRSAYSAQINGKDGAALAVRNLFVKPDFVSAGEKTFGDLVAAQLPAYGDEWKGVNLADGQDGLFNADKAKAEFAKAKKALEADGVQFPIHLDVPVDQASKNYISRIQSFKQSVETVLGVENVVVDIQQMTSDEFLNITYYAANASSEDWDVSGGVSWGPDYQDPSTYLDILKTTSSETTKTYLGFDNPNSPSVVQVGLKEYDKLVDEAARETSDLNVRYEKYAAAQAWLTDSSLFIPAMASSGAAPVLSRIVPFTGASAQTGSKGSDVYFKYLKSQDKVVTKEEYEKAREKWLKEKAESNEKAQKELASHVK

SEQ ID NO: 221 - protein, 318 aa, Streptococcus pneumoniae
MEINVSKLRTDLPQVGVQPYRQVHAHSTGNPHSTVQNEADYHWRKDPELGFFSHIVGNGCIMQVGPVDNGAWDVGGGWNAETYAAVELIESHSTKEEFMTDYRLYIELLRNLADEAGLPKTLDTGSLAGIKTHEYCTNNQPNNHSDHVDPYPYLAKWGISREQFKHDIENGLTIETGWQKNDTGYWYVHSDGSYPKDKFEKINGTWYYFDSSGYMLADRWRKHTDGNWYWFDNSGEMATGWKKIADKWYYFNEEGAMKTGWVKYKDTWYYLDAKEGAMVSNAFIQSADGTGWYYLKPDGTLADKPEFTVEPDGLITVK

SEQ ID NO: 222 - protein, 467 aa, Streptococcus pneumoniae
MKKKYWTLAILFFCLFNNSVTAQEIPKNLDGNITHTQTSESFSESDEKQVDYSNKNQEEVDQNKFRIQIDKTELFVTTDKHLEKNCCKLELEPQINNDIVNSESNNLLGEDNLDNKIKENVSHLDNRGGNIEHDKDNLESSIVRKYEWDIDKVTGGGESYKLYSKSNSKVSIAILDSGVDLQNTGLLKNLSNHSKNYVPNKGYLGKEEGEEGIISDIQDRLGHGTAVVAQIVGDDNINGVNPHVNINVYRIFGKSSASPDWIVKAIFDAVDDGNDIINLSTGQYLMIDGEYEDGTNDFETFLKYKKAIDYANQKGVIIVAALGNDSLNVSNQSDLLKLISSRKKVRKPGLVVDVPSYFSSTISVGGIDRLGNLSDFSNKGDSDAIYAPAGSTLSLSELGLNNFINAEKYKEDWIFSATLGGYTYLYGNSFAAPKVSGAIAMIIDKYKLKDQPYNYMFVKKFWKKHYQ

SEQ ID NO: 223 - protein, 308 aa, Streptococcus pneumoniae
MKKDELFEGFYLIKSADLRQTRAGKNYLAFTFQDDSGEIDGKLWDAQPHNIEAFTAGKVVHMKGRREVYNNTPQVNQITLRLPQAGEPNDPADFKVKSPVDVKEIRDYMSQMIFKIENPVWQRIVRNLYTKYDKEFYSYPAAKTNHHAFETGLAYHTATMVRLADAISEVYPQLNKSLLYAGIMLHDLAKVIELTGPDQTEYTVRGNLLGHIALIDSEITKTVMELGIDDTKEEVVLLRHVILSHHGLLEYGSPVRPRIMEAEIIHMIDNLDASMMMMSTALALVDKGEMTNKIFAMDNRSFYKPDLD

SEQ ID NO: 224 - protein, 221 aa, Streptococcus pneumoniae
VTILGKDTVQQSAKGESVTQEATPEYKLENTPGGDKGGNTGSSDANANEGGGSQAGGSAHTGSQNSAQSQASKQLATEKESAKNAIEKAAKDKQDEIKGAPLSDKEKAELLARVEAEKQAALKEIENAKTMEDVKEAETIGVQAIAMVTVPKRPVAPNAAPKTTSAPQATAGTMQDVTYQSPAGKQLPNTGSASSAALASLGLVVATSGFALLGRKTRRRK

SEQ ID NO: 225 - protein, 336 aa, Streptococcus pneumoniae
MNADDTVTIYDVAREAGVSMATVSRVVNGNKNVKENTRKKVLEVIDRLDYRPNAVARGLASKKTTTVGVVIPNITNGYFSSLAKGIDDIAEMYKYNIVLANSDEDNEKEVSVVNTLFSKQVDGIIYMGYHLTDKIRSEFSRSRTPIVLAGTVDVEHQLPSVNIDYKQATIDAVSYLAKENERIAFVSGPLVDDINGKVRLVGYKETLKKAGITYSEGLVFESKYSYDDGYALAERLISSNATAAVVTGDELAAGVLNGLADKGVSVPEDFEIITSDDSQISRFTRPNLTTIAQPLYDLGAISMRMLTKIMHKEELEEREVLLPHGLTERSSTRKRK

SEQ ID NO: 226 - protein, 469 aa, Streptococcus pneumoniae
MKKKLVFPNLFWWGAASSGPQTEGQYGKVHENVMDYWFKTHPEDFFDNVGPLVASNFFHTYTEDFHLMKEIGVNSFRTSIQWSRLIKNLETGEPDPKGIAFYNAIIEEAKKNQMDLVMNLHHFDLPVELLQKYGGWESKHVVELFVKFAKTAFTCFGDKVHYWTTFNEPMVIPEAGYLYAFHYPNLKGKGKEAVQVIYNLNLASAKVIQLYRSLELDGKIGIILNLTPAYPRSNSPEDLEASRFTDDFFNKVFLNPAVKGTFPERLVKQLERDGVLWSHTEKELQLMKSNTVDFLGVNYYHPKRVQAQANPEEYQTPWMPDQYFKEYEWLERRMNPYRGWEIFPKAIYDIAMIVKEEYGNIPWFISENGMGVENEARFIDENGVIDDVYRIEFYEEHLRWLHKAIEEGSHCFGYHAWTAFDCWSWNNAYKNRYGFISVDLETQKRTIKSSGRWYRKVSDNNGFEVEIEE

SEQ ID NO: 227 - protein, 136 aa, Streptococcus pneumoniae
VENLTNFYEKYRVYLTRPRLELLAVVTIVFCAVLVFFLNIPGKGVLKLDNGTIVYDGSLVRGKMNGQGTITFQNGDQYTGGFNNGAFNGKGTFQSKEGWTYEGDFVNGQAEGKGKLTTEQEVVYEGTFKQGVFQQK

SEQ ID NO: 228 - protein, 207 aa, Streptococcus pneumoniae
MLNKIRDYLDFAGLQYRNPDKAGAEREKMLAFRHKGQEARKVFTELAKAFQASHPEWQLQQTSQWMNQAQRLRPHFWVYLQRDGQVTEPMMALRLYGTSTDFGISLEVSFIERKKDEQTLGKQAKVLDIPTVKGIYYLTYSNGQSQRWEANEEKRRTLREKVRSQEVRKVLVKVDVPMTENSSEEEIVEGLLKSYSKILPYYLATRK

SEQ ID NO: 229 - protein, 152 aa, Streptococcus pneumoniae
MVQNSCWQSKSHKVKAFTLLESLLALIVISGGLLLFQAMSQLLISEVRYQQQSEQKEWLLFVDQLEVELDRSQFEKVEGNRLYMKQDGKDIAIGKSKSDDFRKTNARGRGYQPMVYGLKSVRITEDNQLVRFHFQFQKGLEREFIYRVEKEK

SEQ ID NO: 230 - protein, 108 aa, Streptococcus pneumoniae
MKKMMTFLKKAKVKAFTLVEMLVVLLIISVLFLLFVPNLTKQKEAVNDKGKAAVVKVVESQAELYSLEKNEDASLRKLQADGRITEEQAKAYKEYNDKNGGANRKVND

SEQ ID NO: 231 - protein, 299 aa, Streptococcus pneumoniae
MTSKVRKAVIPAAGLGTRFLPATKALAKEMLPIVDKPTIQFIVEEALKSGIEDILVVTGKSKRSIEDHFDSNFELEYNLKEKGKTDLLKLVDKTTDMRLHFIRQTHPRGLGDAVLQAKAFVGNEPFVVMLGDDLMDITDEKAVPLTKQLMDDYERTHASTIAVMPVPHDEVSAYGVIAPQGEGKDGLYSVETFVEKPAPEDAPSDLAIIGRYLLTPEIFEILEKQAPGAGNEIQLTDAIDTLNKTQRVFAREFKGARYDVGDKFGFMKTSIDYALKHPQVKDDLKNYLIQLGKELTEKE

SEQ ID NO: 232 - protein, 821 aa, Streptococcus pneumoniae
MQNQLNELKRKMLEFFQQKQKNKKSARPGKKGSSTKKSKTLDKSVIFPAILLSIKALFNLLFVLGFLGGMLGAGIALGYGVALFDKVRVPQTEELVNQVKDISSISEITYSDGTVIASIESDLLRTSISSEQISENLKKAIIATEDEHFKEHKGVVPKAVIRATLGKFVGLGSSSGGSTLTQQLIKQQVVGDAPTLARKAAEIVDALALERAMNKDEILTTYLNVAPFGRNNKGQNIAGARQAAEGIFGVDASQLTVPQAAFLAGLPQSPITYSPYENTGELKSDEDLEIGLRRAKAVLYSMYRTGALSKDEYSQYKDYDLKQDFLPSGTVTGISRDYLYFTTLAEAQERMYDYLAQRDNVSAKELKNEATQKFYRDLAAKEIENGGYKITTTIDQKIHSAMQSAVADYGYLLDDGTGRVEVGNVLMDNQTGAILGFVGGRNYQENQNNHAFDTKRSPASTTKPLLAYGIAIDQGLMGSETILSNYPTNFANGNPIMYANSKGTGMMTLGEALNYSWNIPAYWTYRMLREKGVDVKGYMEKMGYEIPEYGIESLPMGGGIEVTVAQHTNGYQTLANNGVYHQKHVISKIEAADGRVVYEYQDKPVQVYSKATATIMQGLLREVLSSRVTTTFKSNLTSLNPTLANADWIGKTGTTNQDENMWLMLSTPRLTLGGWIGHDDNHSLSRRAGYSNNSNYMAHLVNAIQQASPSIWGNERFALDPSVVKSEVLKSTGQKPEKVSVEGKEVEVTGSTVTSYWANKSGAPATSYRFAIGGSDADYQNAWSSIVGSLPTPSSSSSSSSSSSDSSNSSTTRPSSSRARR

SEQ ID NO: 233 - protein, 423 aa, Streptococcus pneumoniae
MSSKFMKSAAVLGTATLASLLLVACGSKTADKPADSGSSEVKELTVYVDEGYKSYIEEVAKAYEKEAGVKVTLKTGDALGGLDKLSLDNQSGNVPDVMMAPYDRVGSLGSDGQLSEVKLSDGAKTDDTTKSLVTAANGKVYGAPAVIESLVMYYNKDLVKDAPKTFADLENLAKDSKYAFAGEDGKTTAFLADWTNFYYTYGLLAGNGAYVFGQNGKDAKDIGLANDGSIVGINYAKSWYEKWPKGMQDTEGAGNLIQTQFQEGKTAAIIDGPWKAQAFKDAKVNYGVATIPTLPNGKEYAAFGGGKAWVIPQAVKNLEASQKFVDFLVATEQQKVLYDKTNEIPANTEARSYAEGKNDELTTAVIKQFKNTQPLPNISQMSAVWDPAKNMLFDAVSGQKDAKTAANDAVTLIKETIKQKFGE

SEQ ID NO: 234 - protein, 155 aa, Streptococcus pneumoniae
MIDKVVRNLLLTFFFCKMTKIIIFLTTILVKKKKICYNEFKLRNRKQKGVIMWVLGFILFMIFFYSNNSKKIKKLENKIKRLERKEKGNAEMSRLLQEMIGKEPIITGVYIGPDNWEVVDVDEEWVKLRRVDNTGKEKFKLQRIEDIQTVEFDGE

SEQ ID NO: 235 - protein, 285 aa, Streptococcus pneumoniae
MILSKNREDGLRKFATNIRLNTLRTLNHLGFGHYGGSLSIVEVLAVLYGEIMPMTPEIFAARDRDYFILSKGHGGPALYSTLYLNGFFDKEFLYSLNTNGTKLPSHPDRNLTPGIDMTTGSLGQGISVATGLAYGQRIRKSPFYTYAIVGDGELNEGQCWEAIQFASHQQLSNLIVFVDDNKKQLDGFTKDICNPGDFVEKFSAFGFESIRVKGSDIREIYEGIVQLKQSNNSSPKCIVLDTIKGQGVQELEEMKSNHHLRPTVEEKQMLTSVVERLSQELEETE

SEQ ID NO: 236 - protein, 621 aa, Streptococcus pneumoniae
MKKTTILSLTTAAVILAAYVPNEPILADTPSSEVIKETKVGSIIQQNNIKYKVLTVEGNIGTVQVGNGVTPVEFEAGQDGKPFTIPTKITVGDKVFTVTEVASQAFSYYPDETGRIVYYPSSITIPSSIKKIQKKGFHGSKAKTIIFDKGSQLEKIEDRAFDFSELEEIELPASLEYIGTSAFSFSQKLKKLTFSSSSKLELISHEAFANLSNLEKLTLPKSVKTLGSNLFRLTTSLKHVDVEEGNESFASVDGVLFSKDKTQLIYYPSQKNDESYKTPKETKELASYSFNKNSYLKKLELNEGLEKIGTFAFADAIKLEEISLPNSLETIERLAFYGNLELKELILPDNVKNFGKHVMNGLPKLKSLTIGNNINSLPSFFLSGVLDSLKEIHIKNKSTEFSVKKDTFAIPETVKFYVTSEHIKDVLKSNLSTSNDIIVEKVDNIKQETDVAKPKKNSNQGVVGWVKDKGLWYYLNESGSMATGWVKDKGLWYYLNESGSMATGWVKDKGLWYYLNESGSMATGWVKDKGLWYYLNESGSMATGWVKDKGLWYYLNESGSMATGWVKDKGLWYYLNESGSMATGWVTVSGKWYYTYNSGDLLVNTTTPDGYRVNANGEWVG

SEQ ID NO: 237 - protein, 626 aa, Streptococcus pneumoniae
MVRFTGLSLKQTQAIEVLKGHISLPDVEVAVTQSDQASISIEGEEGHYQLTYRKPHQLYRALSLLVTVLAEADKVEIEEQAAYEDLAYMVDCSRNAVLNVASAKQMIEILALMGYSTFELYMEDTYQIEGQPYFGYFRGAYSAEELQEIEAYAQQFDVTFVPCIQTLAHLSAFVKWGVKEVQELRDVEDILLIGEEKVYDLIDGMFATLSKLKTRKVNIGMDEAHLVGLGRYLILNGVVDRSLLMCQHLERVLDIADKYGFHCQMWSDMFFKLMSADGQYDRDVEIPEETRVYLDRLKDRVTLVYWDYYQDSEEKYNRNFRNHHKISHDLAFAGGAWKWIGFTPHNHFSRLVAIEANKACRANQIKEVIVTGWGDNGGETAQFSILPSLQIWAELSYRNDLDGLSAHFKTNTGLTVEDFMQIDLANLLPDLPGNLSGINPNRYVFYQDILCPILDQHMTPEQDKPHFAQAAETLANIKEKAGNYAYLFETQAQLNAILSSKVDVGRRIRQAYQADDKESLQQIARQELPELRSQIEDFHALFSHQWLKENKVFGLDTVDIRMGGLLQRIKRAESRIEVYLAGQLDRIDELEVEILPFTDFYADKDFAATTANQWHTIATASTIYTT

SEQ ID NO: 238 - protein, 782 aa, Streptococcus pneumoniae
MSNSFVKLLVSQLFANLADIFFRVTIIANIYIISKSVIATSLVPILIGISSFVASLLVPLVTKRLALNRVLSLSQFGKTILLAILVGMFTVMQSVAPLVTYLFVVAISILDGFAAPVSYAIVPRYATDLGKANSALSMTGEAVQLIGWGLGGLLFATIGLLPTTCINLVLYIISSFLMLFLPNAEVEVLESETNLEILLKGWKLVARNPRLRLFVSANLLEIFSNTIWVSSIILVFVTELLNKTESYWGYSNTAYSIGIIISGLIAFRLSEKFLAAKWEPQLFTPNLKTIQNPCLSLDPGWFLFSPNGCFLLDKKEFPLYGISVEKNTKRKETHMNSLPNHHFQNKSFYQLSFDGGHLTQYGGLIFFQELFSQLKLKERISKYLVTNDQRRYCRYSDSDILVQFLFQLLTGYGTDYACKELSADAYFPKLLEGGQLASQPTLSRFLSRTDEETVHSLRCLNLELVEFFLQFHQLNQLIVDIDSTHFTTYGKQEGVAYNAHYRAHGYHPLYAFEGKTGYCFNAQLRPGNRYCSEEADSFITPVLERFNQLLFRMDSGFATPKLYDLIEKTGQYYLIKLKKNTVLSRLGDLSLPCPQDEDLTILPHSAYSETLYQAGSWSHKRRVCQFSERKEGNLFYDVISLVTNMTSGTSQDQFQLYRGRGQAENFIKEMKEGFFGDKTDSSTLIKNEVRMMMSCIAYNLYLFLKHLAGGDFQTLTIKRFRHLFLHVVGKCVRTGRKQLLKLSSLYAYSELFSALYSRIRKVNLNLPVPYEPPRRKASLMMH

SEQ ID NO: 239 - protein, 693 aa, Streptococcus pneumoniae
MFASKSERKVHYSIRKFSVGVASVVVASLVMGSVVHATENEGATQVPTSSNRANESQAEQGEQPKKLDSERDKARKEVEEYVKKIVGESYAKSTKKRHTITVALVNELNNIKNEYLNKIVESTSESQLQILMMESRSKVDEAVSKFEKDSSSSSSSDSSTKPEASDTAKPNKPTEPGEKVAEAKKKVEEAEKKAKDQKEEDRRNYPTITYKTLELEIAESDVEVKKAELELVKVKANEPRDEQKIKQAEAEVESKQAEATRLKKIKTDREEAEEEAKRRADAKEQGKPKGRAKRGVPGELATPDKKENDAKSSDSSVGEETLPSPSLKPEKKVAEAEKKVEEAKKKAEDQKEEDRRNYPTNTYKTLELEIAESDVEVKKAELELVKEEAKEPRNEEKVKQAKAEVESKKAEATRLEKIKTDRKKAEEEAKRKAAEEDKVKEKPAEQPQPAPAPKAEKPAPAPKPENPAEQPKAEKPADQQAEEDYARRSEEEYNRLTQQQPPKTEKPAQPSTPKTGWKQENGMWYFYNTDGSMATGWLQNNGSWYYLNSNGAMATGWLQNNGSWYYLNANGSMATGWLQNNGSWYYLNANGSMATGWLQYNGSWYYLNANGSMATGWLQYNGSWYYLNANGDMATGWVKDGDTWYYLEASGAMKASQWFKVSDKWYYVNGSGALAVNTTVDGYGVNANGEWVN

SEQ ID NO: 240 - protein, 810 aa, Streptococcus pneumoniae
MNYSKALNECIESAYMVAGHFGARYLESWHLLIAMSNHSYSVAGATLNDYPYEMDRLEEVALELTETDYSQDETFTELPFSRRLQVLFDEAEYVASVVHAKVLGTEHVLYAILHDSNALATRILERAGFSYEDKKDQVKIAALRRNLEERAGWTREDLKALRQRHRTVADKQNSMANMMGMPQTPSGGLEDYTHDLTEQARSGKLEPVIGRDKEISRMIQILSRKTKNNPVLVGDAGVGKTALALGLAQRIASGDVPAEMAKMRVLELDLMNVVAGTRFRGDFEERMNNIIKDIEEDGQVILFIDELHTIMGSGSGIDSTLDAANILKPALARGTLRTVGATTQEEYQKHIEKDAALSRRFAKVTIEEPSVADSMTILQGLKATYEKHHRVQITDEAVETAVKMAHRYLTSRHLPDSAIDLLDEAAATVQNKAKHVKADDSDLSPADKALMDGKWKQAAQLIAKEEEVPVYKDLVTESDILTTLSRLSGIPVQKLTQTDAKKYLNLEAELHKRVIGQDQAVSSISRAIRRNQSGIRSHKRPIGSFMFLGPTGVGKTELAKALAEVLFDDESALIRFDMSEYMEKFAASRLNGAPPGYVGYEEGGELTEKVRNKPYSVLLFDEVEKAHPDIFNVLLQVLDDGVLTDSKGRKVDFSNTIIIMTSNLGATALRDDKTVGFGAKDIRFDQENMEKRMFEELKKAYRPEFINRIDEKVVFHSLSSDHMQEVVKIMVKPLVASLTEKGIDLKLQASALKLLANQGYDPEMGARPLRRTLQTEVEDKLAELLLKGDLVAGSTLKIGVKAGQLKFDIA

SEQ ID NO: 241 - protein, 448 aa, Streptococcus pneumoniae
MKILPFIARGTSYYLKMSVKKLVPFLVVGLMLAAGDSVYAYSRGNGSIARGDDYPAYYKNGSQEIDQWRMYSRQCTSFVAFRLSNVNGFEIPAAYGNANEWGHRARREGYRVDNTPTIGSITWSTAGTYGHVAWVSNVMGDQIEIEEYNYGYTESYNKRVIKANTMTGFIHFKDLDGGSVGNSQSSTSTGGTHYFKTKSAIKTEPLASGTVIDYYYPGEKVHYDQILEKDGYKWLSYTAYNGSYRYVQLEAVNKNPLGNSVLSSTGGTHYFKTKSAIKTEPLVSATVIDYYYPGEKVHYDQILEKDGYKWLSYTAYNGSRRYIQLEGVTSSQNYQNQSGNISSYGSHSSSTVGWKKINGSWYHFKSNGSKSTGWLKDGSSWYYLKLSGEMQTGWLKENGLWYYLGSSGAMKTGWYQVSGKWYYSYSSGALAVNTTVDGYRVNSDGERV

SEQ ID NO: 242 - protein, 150 aa, Streptococcus pneumoniae
MKVIFLADVKGKGKKGEIKEVPTGYAQNFLIKKNLAKEATAQAVGELRGKQKSEEKAHAEMIAEGKAIKAQLEAEETVVEFVEKVGPDGRTFGSITNKKIAEELQKQFGIKIDKRHIQVQAPIRAVGLIDVPVKIYQDITSVINLRVKEG

SEQ ID NO: 243 - protein, 392 aa, Streptococcus pneumoniae
MKKKILASLLLSTVMVSQVAVLTTAHAETTDDKIAAQDNKISNLTAQQQEAQKQVDQIQEQVSAIQAEQSNLQAENDRLQAESKKLEGEITELSKNIVSRNQSLEKQARSAQTNGAVTSYINTIVNSKSITEAISRVAAMSEIVSANNKMLEQQKADKKAISEKQVANNDAINTVIANQQKLADDAQALTTKQAELKAAELSLAAEKATAEGEKASLLEQKAAAEAEARAAAVAEAAYKEKRASQQQSVLASANTNLTAQVQAVSESAAAPVRAKVRPTYSTNASSYPIGECTWGVKTLAPWAGDYWGNGAQWATSAAAAGFRTGSTPQVGAIACWNDGGYGHVAVVTAVESTTRIQVSESNYAGNRTIGNHRGWFNPTTTSEGFVTYIYAD

SEQ ID NO: 244 - protein, 129 aa, Streptococcus pneumoniae
MVKRRIRRGTREPEKVVVPEQSSIPSYPVSVTSNQGTDVAVEPAKAVAPTTDWKQENGMWYFYNTDGSMATGWVQVNSSWYYLNSNGSMKVNQWFQVGGKWYYVNTSGELAVNTSIDGYRVNDNGEWVR

SEQ ID NO: 245 - protein, 46 aa, Streptococcus pneumoniae
ELRRLSRLVDQELYFGCGWRLSLEWLPSMRKDSWPSNTAPRTTMVQ

SEQ ID NO: 246 - protein, 31 aa, Streptococcus pneumoniae
DCIRKQPFTRDEPNKTCRKTKPSKSYCSYRW

SEQ ID NO: 247 - protein, 26 aa, Streptococcus pneumoniae
GQRNPRRIERVIRMAETKPRISKKEG

SEQ ID NO: 248 - protein, 83 aa, Streptococcus pneumoniae
QRKLFKIFHLFQKKSGWNQKSSCLKLNLNSLNRKMTQMTKMFRSIFQPKKPLNTNFQAYNSLHQINQKISLKRRKLSEKISKS

SEQ ID NO: 249 - protein, 104 aa, Streptococcus pneumoniae
LVIIVLKIQSKSETDFIFKTWPFILLSKIIPLMVLDCQVSISWTNRETVAYSKLLAIKTLKGDYHDGQSKKIRLSHASRVRTPSWYPHDMADSTRIMAFSRKGC

SEQ ID NO: 250 - protein, 30 aa, Streptococcus pneumoniae
ERLPAFPRSLSGRKLDQGGTKEKGSDGRSP

SEQ ID NO: 251 - protein, 245 aa, Streptococcus pneumoniae
RNCLSTWKSSSNYHTEIKRGTVRQCLGKGRFKEVYSADYAQQSYENNRKRSVKKSSLTKELKEKILHYHNQKFSPEMMVMAKGVNVGISTIYYWIHHGKLGLSKQDLLYPRKGKALKKQASTNFKPAGQSIEQRPEAINLRLENGHYEIDTVLLTRSKNYCLIVLTDRKSRHQIIRLIPNKSAEVVNQALKLILKQHKILSITADNGTEFNRLFDIFSEEHIYYAHPYASWERGTNENHNRLIRR

SEQ ID NO: 252 - protein, 36 aa, Streptococcus pneumoniae
PVMTISSPTMKNMDLSTKASPSQPLQGKHGMIWSGK

SEQ ID NO: 253 - protein, 28 aa, Streptococcus pneumoniae
TSSIRIHTRKSSPNWTTTPHLALSAETN

SEQ ID NO: 254 - protein, 27 aa, Streptococcus pneumoniae
YFLPHKYARESLSLPSTNKILHRKQGS

SEQ ID NO: 255 - protein, 53 aa, Streptococcus pneumoniae
AAFKKDQINERVEKLGKLKPITINYNGKSEVIDSKEKLQELMNKAVKDEVAQI

SEQ ID NO: 256 - protein, 33 aa, Streptococcus pneumoniae
AYAHSKRSAGSGRAGGRQCLCQCQNKCRRDFKY

SEQ ID NO: 257 - protein, 36 aa, Streptococcus pneumoniae
HGRPYHKPHQPHHHGFPQQSYNLLPPKHKPTLCVRR

SEQ ID NO: 258 - protein, 130 aa, Streptococcus pneumoniae
KGKILLLPRLTTQRWQRKIRPDSRKSANNKANLDFHNSRCKSSLSDEAPNLHKNPALLVHSLSRVIAVLLELSPLQAYSIVKFSPKEDDLIHDDAILVRFGILEVHDSPYELLLLYHTHSYRFSCSIYLS

SEQ ID NO: 259 - protein, 144 aa, Streptococcus pneumoniae
FTVSHVFLLYLSFNPRPKSMSLSFTSSKLLRPRFRTFIISASDFSVKSCTVLIPARFKQLYERTDKSSSSIVRSKIRSSDSVSASFITSVDLAISVRFVNKSRCSVKIRAESPKASSGIIVPFVKISRVNLSKPSLLPTRAGST

SEQ ID NO: 260 - protein, 18 aa, Streptococcus pneumoniae
LVCMKNKGCYKERNNCCH

SEQ ID NO: 261 - protein, 58 aa, Streptococcus pneumoniae
FHYLSKYFLVSAITTGDKTKRAIKFGRAIKALTISAIIQTISNSINPPNKTMSTKTTR

SEQ ID NO: 262 - protein, 47 aa, Streptococcus pneumoniae
GKKVFIKYPLSRVSSKTGPMITGRTKDKIVDKKVGCPFEKSTVKYSS

SEQ ID NO: 263 - protein, 37 aa, Streptococcus pneumoniae
SSPVFPKLVMVSGANKPRERRNFPFSSKMSFHLTFVL

SEQ ID NO: 264 - protein, 77 aa, Streptococcus pneumoniae
YLTSFSVPKIASSKVKLTRYWRSSPWRGAFGLREEPPPPKKLEKISSKPPKPPAPLKPPKPPAPPKPPLAPAAPYWS

SEQ ID NO: 265 - protein, 89 aa, Streptococcus pneumoniae
QSWRPIPDSKCYTQEKLTIPIKRRKDIKDFYHNSIQRHKNSHKSHLLDSYRLIITRLAEIVHENKILIVLILYVTNIPSRSRRYEVNRV

SEQ ID NO: 266 - protein, 60 aa, Streptococcus pneumoniae
LFRFYRVIVLYRGWHIYLLILVNLQYVQNVFRKDRFLVRGAQPFFHGERSAGHLVLPYVL

SEQ ID NO: 267 - protein, 60 aa, Streptococcus pneumoniae
ITHPPLNPEHFVSRVFSSLGLKSYQPKDDRFLRKPSDSRHPESGNSGKWQVLNSPLVIVK

SEQ ID NO: 268 - protein, 30 aa, Streptococcus pneumoniae
TLAKAVGLMYSPPIPPKPFLGRITTDSSSI

SEQ ID NO: 269 - protein, 83 aa, Streptococcus pneumoniae
PGSPFSEISGAGFFGVAKRIFPRPPRPPWATINSCPCSIKSVKTLPVSASRTVVPCGTRTLRSSAPRPCIPLVIPFSPESALK

SEQ ID NO: 270 - protein, 111 aa, Streptococcus pneumoniae
INSLTLATSLSKRRAPRKASKASPRMVSRLRPPDFSSPLPNLINWSNWQSRAKPAKLSSRTIIARSFDRSPSGFLGYFLYRYSEINNCRTASPKNSKRSLCEIFKRRCSLA

SEQ ID NO: 271 - protein, 49 aa, Streptococcus pneumoniae
PIGKRNCKAECQSHHLLEKQKTFQSRKTKRYGASPEPRYRESRKPRLSQ

SEQ ID NO: 272 - protein, 58 aa, Streptococcus pneumoniae
QPLGHSKAEEHETICSHTFDNHTTETIPNQVKGRDMTSSETLPFPSKNQNQGKAKQIP

SEQ ID NO: 273 - protein, 125 aa, Streptococcus pneumoniae
PCSLPDYGLVGSGYHSCHYQSNDTRFLESHGNWRTLLYSWSWILCQEKTLFPHDLASLYPSCVRTSIHRYCLLHVKKLRNSISTFFFTHIDKVLVQAHIISQFWMKRTYQHIFFLGCNNLIVHCC

SEQ ID NO: 274 - protein, 69 aa, Streptococcus pneumoniae
RVKDNHLDKLVKALLKRRSSTQYYIHQLLRKMIRLYGHQQLHNNSEILVYSDYGHVDLLLLETNKIPVY

SEQ ID NO: 275 - protein, 40 aa, Streptococcus pneumoniae
QVIKIDIATTNKTESVKSQSEREKKRLTSSNILKVRGRPI

SEQ ID NO: 276 - protein, 32 aa, Streptococcus pneumoniae
AFKSSKVPSLDPSSTKTYSISVSKSGSKASRA

SEQ ID NO: 277 - protein, 69 aa, Streptococcus pneumoniae
DKTDPLARKLPDKSKPSTSFCTKSLSPVNMASLTSAKPSKTKASLGICSPADKRMTSPSTNSSGLRATS

SEQ ID NO: 278 - protein, 38 aa, Streptococcus pneumoniae
LCRLQTQARPRGSVTNLTKQNKVYRYLNYLRQTQLSAM

SEQ ID NO: 279 - protein, 110 aa, Streptococcus pneumoniae
CIQSIGNEGQCKGNSCYVGKEIHLAPISDIVGHKGKEEGDDGNDDGRQFYLFLAHLVGSAFLRSFPLLYSKGINEEGDGIGNDGRLISKDIINSTGQNGINNTKVISPFA

SEQ ID NO: 280 - protein, 121 aa, Streptococcus pneumoniae
TSTKLVIDTTTFMTFCTNNTKSSKFTNTFTKLDVGTTTRHVGCDGNGTTLTSIHDDLGFSIVVFGIQDFVRNTSCNQFLRNVVTSFNRYCTNQDRLTLLVTSLNVFDNRFKLRFDTCIKKV

SEQ ID NO: 281 - protein, 27 aa, Streptococcus pneumoniae
ISTGVPTCSMYPLLKTAILSDKVKASS

SEQ ID NO: 282 - protein, 34 aa, Streptococcus pneumoniae
LSTMSSIKSILCSLPTHTIFSKSAISPKRGSTAI

SEQ ID NO: 283 - protein, 111 aa, Streptococcus pneumoniae
SCSYSSTNSKACSIVGLSKPTIFICVTPISAAKAISSASRPANSSTFKCVCVSKIISSNLVFYLLLYQKRGGAPNFSVSPPLFNRELFCYLFYPILPISYSTVRDRRDWLH

SEQ ID NO: 284 - protein, 110 aa, Streptococcus pneumoniae
VTSCIVPAVACGALVVLGAALGATGLLGTVTMAMACTPIVSASFTSSIVFAFSISLRAACFSASTLAKSSAFSLSESGAPLISSCLSLAAFSMAFLADSFSVANCLEACD

SEQ ID NO: 285 - protein, 53 aa, Streptococcus pneumoniae
YSPFNHSILIRKTTKIINPNPKAPRMNWRSKVWSNQPVNISTNHTKSDRPIKK

SEQ ID NO: 286 - protein, 48 aa, Streptococcus pneumoniae
DYFKFRTTFTRFSTVKPYSANTFGAGAEAPKVSIPRTAPSRPTYLYQF

SEQ ID NO: 287 - protein, 74 aa, Streptococcus pneumoniae
RGRRGLCVARIKAPRLVIKPKRTIDPPTKDRYSPPLSATSLSVPKSPIISFPAKMDKNPKRKLNSKVIFNASVT

SEQ ID NO: 288 - protein, 30 aa, Streptococcus pneumoniae
TPPYTKIPAKTAIIPFISAQDFNQAQRLSG

SEQ ID NO: 289 - DNA, 1176 bp, Streptococcus pneumoniae
atgaagaaaaaaatcttagcgtcacttttattaagtacagtaatggtttctcaagtagctgttttaacaactgcgcatgcagaaacgactgatgacaaaattgctgctcaagataataaaattagtaacttaacagcacaacaacaagaagcccaaaaacaagttgaccaaattcaggagcaagtatcagctattcaagctgagcagtctaacttgcaagctgaaaatgatagattacaagcagaatctaagaaactcgagggtgagattacagaactttctaaaaacattgtttctcgtaaccaatcgttggaaaaacaagctcgtagtgctcaaacaaatggagccgtaactagctatatcaataccattgtaaactcaaaatcaattacagaagctatttcacgtgttgctgcaatgagtgaaatcgtatctgcaaacaacaaaatgttagaacaacaaaaggcagataaaaaagctatttctgaaaaacaagtagcaaataatgatgctatcaatactgtaattgctaatcaacaaaaattggctgatgatgctcaagcattgactacgaaacaggcagaactaaaagctgctgaattaagtcttgctgctgagaaagcgacagctgaaggggaaaaagcaagtctattagagcaaaaagcagcagctgaggcagaggctcgtgcagctgcggtagcagaagcagcttataaagaaaaacgagctagccaacaacaatcagtacttgcttcagcaaacactaacttaacagctcaagtgcaagcagtatctgaatctgcagcagcacctgtccgtgcaaaagttcgtccaacatacagtacaaacgcttcaagttatccaattggagaatgtacatggggagtaaaaacattggcaccttgggctggagactactggggtaatggagcacagtgggctacaagtgcagcagcagcaggtttccgtacaggttcaacacctcaagttggagcaattgcatgttggaatgatggtggatatggtcacgtagcggttgttacagctgttgaatcaacaacacgtatccaagtatcagaatcaaattatgcaggtaatcgtacaattggaaatcaccgtggatggttcaatccaacaacaactcctgaaggttttgttacatatatttatgcagat

SEQ ID NO: 290 - DNA, 1176 bp, Streptococcus pneumoniae
atgaagaaaaaaatcttagcgtcacttttattaagtacagtaatggtttctcaagtagctgttttaacaactgcgcatgcagaaacgactgatgacaaaattgctgctcaagataataaaattagtaacttaacagcacaacaacaagaagcccaaaaacaagttgaccaaattcaggagcaagtatcagctattcaagctgagcagtctaacttgcaagctgaaaatgatagattacaagcagaatctaagaaactcgagggtgagattacagaactttctaaaaacattgtttctcgtaaccaatcgttggaaaaacaagctcgtagtgctcaaacaaatggagccgtaactagctatatcaataccattgtaaactcaaaatcaattacagaagctatttcacgtgttgctgcaatgagtgaaatcgtatctgcaaacaacaaaatgttagaacaacaaaaggcagataaaaaagctatttctgaaaaacaagtagcaaataatgatgctatcaatactgtaattgctaatcaacaaaaattggctgatgatgctcaagcattgactacgaaacaggcagaactaaaagctgctgaattaagtcttgctgctgagaaagcgacagctgaaggggaaaaagcaagtctattagagcaaaaagcagcagctgaggcagaggctcgtgcagctgcggtagcagaagcagcttataaagaaaaacgagctggccaacaacaatcagtacttgcttcagcaaacactaacttaacagctcaagtgcaagcagtatctgaatctgcagcagcacctgtccgtgcaaaagttcgtccaacatacagtacaaacgcttcaagttatccaattggagaatgtacatggggagtaaaaacattggcaccttgggctggagactactggggtaatggagcacagtgggctacaagtgcagcagcagcaggtttccgtacaggttcaacacctcaagttggagcaattgcatgttggaatgatggtggatatggtcacgtagcggttgttacagctgttgaatcaacaacacgtatccaagtatcagaatcaaattatgcaggtaatcgtacaattggaaatcaccgtggatggttcaatccaacaacaacttctgaaggttttgttacatatatttatgcagat

SEQ ID NO: 291 - DNA, 1761 bp, Streptococcus pneumoniae
atgatccaaatcggcaagatttttgccggacgctatcggattgtcaaacagattggtcgaggaggtatggcggatgtctacctagccaaagacttaatcttagatggggaagaagtggcagtgaaggttctgaggaccaactaccagacggacccgatagctgtagctcgttttcagcgtgaagcgagagctatggcagatctagaccatcctcatatcgttcggataacagatattggcgaggaagacggtcaacagtacctagctatggagtatgtggctggactggacctcaaacgctatatcaaggaacattatcctctttctaatgaagaagcagcccgtatcatgggacaaattctcttggctatgcgcttggcccatactcgaggaattgttcacagggacttgaaacctcaaaatatcctcttgacaccagatgggactgccaaggtcacagactttgggattgctgtagcctttgcagagacaagtctgacccagactaactcgatgttgggctcagttcattacttgtcaccagagcaggcgggtggttcgaaggcgactgtgcagagtgatatctatgccatggggattattttctatgagatgctgacaggccatatcccttatgacggggatagcgcggtgaccattgccctccagcatttccagaaacccctgccgtccgttattgcagaaaatccatctgtacctcaggctttagaaaatgttattatcaaggcaactgctaaaaagttgaccaatcgctaccgctcggtttcagagatgtatgtggacttgtctagtagcttgtcctacaatcgtagaaatgaaagtaagttaatctttgatgaaacgagcaaggcagataccaagaccttgccgaaggtttctcagagtaccttgacatctattcctaaggttcaagcgcaaacagaacacaaatcaatcaaaaacccaagccaggctgtgacagaggaaacttaccaaccacaagcaccgaaaaaacatagatttaagatgcgttacctgattttgttggccagccttgtattggtggcagcttctcttatttggatactatccagaactcctgcaaccattgccattccagatgtggcaggtcagacagttgcagaggccaaggcaacgctcaaaaaagccaattttgagattggtgaggagaagacagaggctagtgaaaaggtggaagaagggcggattatccgtacagatcctggcgctggaactggtcgaaaagaaggaacgaaaatcaatttggttgtctcatcaggcaagcaatctttccaaattagtaattatgtcggtcggaaatcctctgatgtcattgcggaattaaaagagaaaaaagttccagataatttgattaaaattgaggaagaagagtcgaatgagagtgaggctggaacggtcctgaagcaaagtctaccagaaggtacgacctatgacttgagcaaggcaactcaaattgtcttgacagtagctaaaaaagttacaagtgttgccatgccgagttacattggttctagcttggagtttactaagaacaatttgattcaaattgttgggattaaggaagctaatatagaagttgtagaagtgacgacagcgcctgcaggtagtgcagaaggcatggttgttgaacaaagtcctagagcaggtgaaaaggtagacctcaataagactagagtcaagatttcaatctacaaacctaaaacaacttcagctactcct

SEQ ID NO: 292 - DNA, 1977 bp, Streptococcus pneumoniae
atgatccaaatcggcaagatttttgccggacgctatcggattgtcaaacagattggtcgaggaggcatggcggatgtctacctagccaaagacttaatcttagatggggaagaagtggcagtgaaggttctgaggaccaactaccagacggacccgatagctgtagctcgttttcagcgtgaagcgagagctatggcagatctagaccatcctcatatcgttcggataacagatattggtgaggaagacggtcaacagtatcttgcaatggagtatgttgctggactagacctcaaacgctatatcaaggaacattatcctctttctaatgaagaagcagtccgtatcatgggacaaattctcttggctatgcgcttggcccatactcgaggaattgttcacagggacttgaaacctcaaaatatccttttgacaccagatgggacggccaaggtcacagactttgggattgctgtagcctttgcagagacaagtctgacccagactaactcgatgttgggctcagttcattacttgtcaccagagcaggcgcgtggttcgaaggcgactgtgcagagtgatatctatgccatggggattattttctatgagatgttgacaggccatatcccttatgacggggatagcgcggtgaccattgccctccagcatttccagaaacccctgccgtccgttattgcagaaaatccatctgtacctcaggctttagaaaatgttattatcaaggcaactgctaaaaagttgaccaatcgctaccgctcggtttcagagatgtatgtggacttgtctagtagcttgtcctacaatcgtagaaatgaaagtaagttaatctttgatgaaacgagcaaggcagataccaagaccttgccgaaggtttctcagagtaccttgacatctattcctaaggttcaagcgcagacagaacacaaatcaatcaaaaacccaagccaggctgtgacagaggaaacttaccaaccacaagcaccgaaaaaacatagatttaagatgcgttacctgattttgttggccagccttgtattggtggcagcttctcttatttggatactatccagaactcctgcaaccattgccattccagatgtggcaggtcagacagttgcagaggccaaggcaacgctcaaaaaagccaattttgagattggtgaggagaagacagaggctagtgaaaaggtggaagaagggcggattatccgtacagatcctggcgctggaactggtcgaaaagaaggaacgaaaatcaatttggttgtctcatcaggcaaacaatccttccaaattagtaattatgtcggccggaaatcttctgatgttatcgcggaattaaaagagaaaaaagttccagataatttgattaaaattgaggaagaagagtcgaatgagagtgaggctggaacggtcctgaagcaaagtctaccagaaggtacgacctatgacttgagcaaggcaactcaaattgttttgacagtagctaaaaaagctacgacgattcaattagggaactatattggacggaactctacagaagtaatctcagaactcaagcagaagaaggttcctgagaatttgattaagatagaggaagaagagtccagcgaaagcgaaccaggaacgattatgaaacaaagtccaggtgccggaacgacttatgatgtgagtaaacctactcaaattgtcttgacagtagctaaaaaagttacaagtgttgccatgccgagttacattggttccagcttggagtttactaagaacaatttgattcaaattgttgggattaaggaagctaatatagaagttgtagaagtgacgacagcgcctgcaggtagtgtagaaggcatggttgttgaacaaagtcctagagcaggtgaaaaggtagacctaaataagactagagtcaagatttcaatctacaaacctaaaacaacttcagctactcct

SEQ ID NO: 293 - DNA, 1977 bp, Streptococcus pneumoniae
atgatccaaatcggcaagatttttgccggacgctatcggattgtcaaacagattggtcgaggaggtatggcggatgtctacctagccaaagacttaatcttagatggggaagaagtggcagtgaaggttctgaggaccaactaccagacggacccgatagctgtagctcgttttcagcgtgaagcgagagctatggcagatctagaccatcctcatatcgttcggataacagatattggtgaggaagacggtcaacagtatcttgcaatggagtatgttgctggactagacctcaaacgctatatcaaggaacattatcctctttctaatgaagaagcagtccgtatcatgggacaaatcctcctagccatgcgtttggcccataccagaggaattgttcacagggacttgaaacctcaaaatatccttttgacaccagatgggactgccaaggtcacagactttgggattgctgtagcctttgcagagacaagtctgacccagactaactcgatgttgggctcagttcattacttgtccccagagcaggcgcgtggttcgaaggcgactgtgcagagtgatatctatgctatggggattattttctatgagatgttgacaggccatatcccttatgacggggatagcgcggtgaccattgccctccagcatttccagaaacccctgccgtccgttattgcagaaaatccatctgtacctcaggctttagaaaatgttattatcaaggcaactgctaaaaagttgaccaatcgctaccgctcggtttcagagatgtatgtggacttgtctagtagcttgtcctacaatcgtagaaatgaaagtaagttaatctttgatgaaacgagcaaggcagataccaagaccttgccgaaggtttctcagagtaccttgacatctattcctaaggttcaagcgcagacagaacacaaatcaatcaaaaacccaagccgggctgtgacagaggaaacttaccaaccacaagcaccgaaaaaacatagatttaagatgcgttacctgattttgttggccagccttgtattggtggcagcttctcttatttggatactatccagaactcctgcaaccattgccattccagatgtggcaggtcagacagttgcagaggccaaggcaacgctcaaaaaagccaattttgagattggtgaggagaagacagaggctagtgaaaaggtggaagaagggcggattatccgtacagatcctggcgctggaactggtcgaaaagaaggaacgaaaatcaatctggttgtctcatcaggcaaacaatccttccaaattagtaattatgtcggccggaaatcttctgatgttatcgcggaattaaaagagaaaaaagttccagataatttgattaaaattgaggaagaagagtcgaatgagagtgaggctggaacggtcctgaagcaaagtctaccagaaggtacgacctatgacttgagcaaggcaactcaaattgttttgacagtagctaaaaaagctacgacgattcaattagggaactatattggacggaactctacagaagtaatctcagaactcaagcagaagaaggttcctgagaatttgattaagatagaggaagaagagtccagcgaaagcgaaccaggaacgattatgaaacaaagtccaggtgccggaacgacttatgatgtgagtaaacctactcaaattgtcttgacagtagctaaaaaagttacaagtgttgccatgccgagttacattggttccagcttggagtttactaagaacaatttgattcaaattgttgggattaaggaagctaatatagaagttgtagaagtgacgacagcgcctgcaggtagtgcagaaggcatggttgttgaacaaagtcctagagcaggtgaaaaggtagacctcaataagactagagtcaagacttcaatctacaaacctaaaacaacttcagctactcct

SEQ ID NO: 294 - DNA, 1977 bp, Streptococcus pneumoniae
atgatccaaatcggcaagatttttgccggacgctatcggattgtcaaacagattggtcgaggaggcatggcggatgtctacctagccaaagacttaatcttagatggggaagaagtggcagtgaaggttctgaggaccaactaccagacggacccgatagctgtagctcgttttcagcgtgaagcgagagctatggcagatctagaccatcctcatatcgttcggataacagatattggtgaggaagacggtcaacagtatcttgcaatggagtatgttgctggactagacctcaaacgctatatcaaggaacattatcctctttctaatgaagaagcagtccgtatcatgggacaaattctcttggctatgcgcttggcccatactcgaggaattgttcacagggacttgaaacctcaaaatatccttttgacaccagatgggacggccaaggtcacagactttgggattgctgtagcctttgcagagacaagtctgacccagactaactcgatgttgggctcagttcattacttgtcaccagagcaggcgcgtggttcgaaggcgactgtgcagagtgatatctatgccatggggattattttctatgagatgttgacaggccatatcccttatgacggggatagcgcggtgaccattgccctccagcatttccagaaacccctgccgtccgttattgcagaaaatccatctgtacctcaggctttagaaaatgttattatcagggcaactgctaaaaagttgaccaatcgctatcgctcggtttcagagatgtatgtagacttgtctagtagcttgtcctacaatcgtagaaatgaaagtaagttaatctttgatgaaacgagcaaggcagataccaagaccttgccgaaggtttctcagagtaccttgacatctattcctaaggttcaagcgcagacaggacacaaatcaatcaaaaacccaagccaggctgtgacagaggaaacttaccaaccacaagcaccgaaaaaacatagatttaagatgcgttacctgattttgttggccagccttgtattggtggcagcttctcttatttggatactatccagaactcctgcaaccattgccattccagatgtggcaggtcagacagttgcagaggccaaggcaacgctcaaaaaagccaattttgagattggtgaggagaagacagaggctagtgaaaaggtggaagaagggcggattatccgtacagatcctggcgctggaactggtcgaaaagaaggaacgaaaattaatctggttgtctcatcaggcaaacaatccttccaaattagtaattatgtcggccggaaatcttctgatgttatcgcggaattaaaagagaaaaaagttccagataatttgattaaaattgaggaagaagagtcgaatgagagtgaggctggaacggtcctgaagcaaagtctaccagaaggtacgacctatgacttgagcaaggcaactcaaattattttgacagtagctaaaaaagctacgacgattcaattagggaactatattggacggaactctacagaagtaatctcagaactcaagcagaagaaggttcctgagaatttgattaagatagaggaagaagagtccagcgaaagcgaaccaggaacgattatgaaacaaagtccaggtgccggaacgacttatgatgtgagtaaacctactcaaattgtcttgacagtagctaaaaaagttacaagtgttgccatgccgagttacattggttccagcttggagtttactaagaacaatttgattcaaattgttgggattaaggaagctaatatagaagttgtagaagtgacgacagcgcctgcaggtagtgcagaaggcatggttgttgaacaaagtcctagagcaggtgaaaaggtagacctaaataagactagagtcaagatttcaatctacaaacctaaaacaacttcagctactcct

SEQ ID NO: 295 - DNA, 1980 bp, Streptococcus pneumoniae
atgatccaaatcggcaagatttttgccggacgctatcggattgtcaaacagattggtcgaggaggcatggcggatgtctacctagccaaagacttaatcttagatggggaagaagtggcagtgaaggttctgaggaccaactaccagacggacccgatagctgtagctcgttttcagcgtgaagcgagagctatggcagatctagaccatcctcatatcgttcggataacagatattggtgaggaagacggtcaacagtatcttgcaatggagtatgttgctggactagacctcaaacgctatatcaaggaacattatcctctttctaatgaagaagcagtccgtatcatgggacaaattctcttggctatgcgcttggcccatactcgaggaattgttcacagggacttgaaacctcaaaatatccttttgacaccagatgggactgccaaggtcacagactttgggattgctgtagcctttgcagagacaagtctgacccagactaactcgatgttgggctcagttcattacttgtcaccagagcaggcgcgtggttcgaaggcgactgtgcagagtgatatctatgccatggggattattttctatgagatgttgacaggccatatcccttatgacggggatagcgcggtgaccattgccctccagcatttccagaaccccctgccgtccgttattgcagaaaattcatctgtacctcaggctttagaaaatgttattatcaaggcaactgctaaaaagttgaccaatcgctatcgctcggtttcagagatgtatgtagacttgtctagtagcttgtcctacaatcgtagaaatgaaagtaagttaatctttgatgaaacgagcaaggcagataccaagaccttgccgaaggtttctcagagtaccttgacatctattcctaaggttcaagcgcagacagaacacaaatcaatcaaaaacccaagccaggctgtgacagaggaaacttaccaaccacaagcaccgaaaaaacatagatttaagatgcgttacctgattttgttggccagccttgtattggtggcagcttctcttatttggatactatccagaactcctgcaaccattgccattccagatgtggcaggtcagacagttgcagaggccaaggcaacgctcaaaaaagccaattttgagattggtgaggagaagacagaggctagtgaaaaggtggaagaagggcggattatccgtacagatcctggcgctggaactggtcgaaaagaaggaacgaaaattaatctggttgtctcatcaggcaaacaatccttccaaattagtaattatgtcggccggaaatcttctgatgttatcgcggaattaaaagagaaaaaagttccagataatttgattaaaattgaggaagaagagtcgaatgaaagtgaggctggaacggtcctgaagcaaagtctaccagaaggtacgacctatgacttgagcaaggcaactcaaattgttttgacagtagctaaaaaagctacgacgattcaattagggaactatattggacggaactctacagaagtaatctcagaactcaagcagaagaaggttcctgagaatttgattaagatagaggaagaagagtccagcgaaagcgaaccaggaacgattatgaaacaaagtccaggtgccggaacgacttatgatgtgagtaaacctactcaaattgtcttgacagtagctaaaaaagttacaagtgttgccatgccgagttacattggttccagcttggagtttactaagaacaatttgattcaaattgttgggattaaggaagctaatatagaagttgtagaagtgacgacagcgcctgcaggtagtgtagaaggcatggttgttgaacaaagtcctagagcaggtgaaaaggtagacctaaataagactagagtcaagatttcaatctacaaacctaaaacaacttcagctactccttaa

SEQ ID NO: 296 - DNA, 2106 bp, Streptococcus pneumoniae
atgtttgcatcaaaaagcgaaagaaaagtacattattcaattcgtaaatttagtattggagtagctagtgtagctgttgccagtcttgttatgggaagtgtggttcatgcgacagagaacgagggaagtacccaagcagccacttcttctaatatggcaaagacagaacataggaaagctgctaaacaagtcgtcgatgaatatatagaaaaaatgttgagggagattcaactagatagaagaaaacatacccaaaatgtcgccttaaacataaagttgagcgcaattaaaacgaagtatttgcgtgaattaaatgttttagaagagaagtcgaaagatgagttgccgtcagaaataaaagcaaagttagacgcagcttttgagaagtttaaaaaagatacattgaaaccaggagaaaaggtagcagaagctaagaagaaggttgaagaagctaagaaaaaagccgaggatcaaaaagaagaagatcgtcgtaactacccaaccaatacttacaaaacgcttgaacttgaaattgctgagttcgatgtgaaagttaaagaagcggagcttgaactagtaaaagaggaagctaaagaatctcgaaacgagggcacaattaagcaagcaaaagagaaagttgagagtaaaaaagctgaggctacaaggttagaaaacatcaagacagatcgtaaaaaagcagaagaagaagctaaacgaaaagcagatgctaagttgaaggaagctaatgtagcgacttcagatcaaggtaaaccaaaggggcgggcaaaacgaggagttcctggagagctagcaacacctgataaaaaagaaaatgatgcgaagtcttcagattctagcgtaggtgaagaaactcttccaagctcatccctgaaatcaggaaaaaaggtagcagaagctgagaagaaggttgaagaagctgagaaaaaagccaaggatcaaaaagaagaagatcgccgtaactacccaaccaatacttacaaaacgcttgaccttgaaattgctgagtccgatgtgaaagttaaagaagcggagcttgaactagtaaaagaggaagctaaggaacctcgagacgaggaaaaaattaagcaagcaaaagcgaaagttgagagtaaaaaagctgaggctacaaggttagaaaacatcaagacagatcgtaaaaaagcagaagaagaagctaaacgaaaagcagcagaagaagataaagttaaagaaaaaccagctgaacaaccacaaccagcgccggctactcaaccagaaaaaccagctccaaaaccagagaagccagctgaacaaccaaaagcagaaaaaacagatgatcaacaagctgaagaagactatgctcgtagatcagaagaagaatataatcgcttgactcaacagcaaccgccaaaaactgaaaaaccagcacaaccatctactccaaaaacaggctggaaacaagaaaacggtatgtggtacttctacaatactgatggttcaatggcaacaggatggctccaaaacaacggttcatggtactatctaaacgctaatggtgctatggcgacaggatggctccaaaacaatggttcatggtactatctaaacgctaatggttcaatggcaacaggatggctccaaaacaatggttcatggtactacctaaacgctaatggtgctatggcgacaggatggctccaatacaatggttcatggtactacctaaacagcaatggcgctatggcgacaggatggctccaatacaatggctcatggtactacctcaacgctaatggtgatatggcgacaggatggctccaaaacaacggttcatggtactacctcaacgctaatggtgatatggcgacaggatggctccaatacaacggttcatggtattacctcaacgctaatggtgatatggcgacaggttgggtgaaagatggagatacctggtactatcttgaagcatcaggtgctatgaaagcaagccaatggttcaaagtatcagataaatggtactatgtcaatggctcaggtgcccttgcagtcaacacaactgtagatggctatggagtcaatgccaatggtgaatgggtaaactaa

SEQ ID NO: 297 - DNA, 1501 bp, Streptococcus pneumoniae
  misc_feature (491)..(530): "n or x" represents undefined/missing nucleotides or amino acides due to unavailable sequencing information..
atgtttgcatcaaaaagcgaaagaaaagtacattattcaattcgtaaatttagtgttggagtagctagtgtagttgttgccagtcttgttatgggaagtgtggttcatgcgacagagaacgagggagctacccaagtacccacttcttctaatagggcaaatgaaagtcaggcagaacaaggagaacaacctaaaaaactcgattcagaacgagataaggcaaggaaagaggtcgaggaatatgtaaaaaaaatagtgggtgagagctatgcaaaatcaactaaaaagcgacatacaattactgtagctctagttaacgagttgaacaacattaagaacgagtatttgaataaaatagttgaatcaacctcagaaagccaactacagatactgatgatggagagtcgatcaaaagtagatgaagctgtgtctaagtttgaaaaggactcaccttcttcgtcaagttcagactcttccactaaaccggaagnnnnnnnnnnnnnnnnnnnnnnnnnnnnnnnnnnnnnnnnttgctgagtccgatgtggaagttaaaaaagcggagcttgaactagtaaaagaggaagctaaggaacctcgaaacgaggaaaaagttaagcaagcaaaagcggaagttgagagtaaaaaagctgaggctacaaggttagaaaaaatcaagacagatcgtaaaaaagcagaagaagaagctaaacgaaaagcagcagaagaagataaagttaaagaaaaaccagctgaacaaccacaaccagcgccggctccaaaagcagaaaaaccagctccagctccaaaaccagagaatccagctgaacaaccaaaagcagaaaaaccagctgatcaacaagctgaagaagactatgctcgtagatcagaagaagaatataatcgcttgactcaacagcaaccgccaaaaactgaaaaaccagcacaaccatctactccaaaaacaggctggaaacaagaaaacggtatgtggtacttctacaatactgatggttcaatggcgacaggatggctccaaaacaatggctcatggtactacctcaacagcaatggcgctatggcgacaggatggctccaaaacaatggttcatggtactatctaaacgctaatggttcaatggcaacaggatggctccaaaacaatggttcatggtactacctaaacgctaatggttcaatggcgacaggatggctccaatacaatggctcatggtactacctaaacgctaatggttcaatggcgacaggatggctccaatacaatggctcatggtactacctaaacgctaatggtgatatggcgacaggttgggtgaaagatggagatacctggtactatcttgaagcatcaggtgctatgaaagcaagccaatggttcaaagtatcagataaatggtactatgtcaatggctcaggtgcccttgcagtcaacacaactgtagatggctatggagtcaatgccaatggtgaatgggtaaac

SEQ ID NO: 298 - DNA, 845 bp, Streptococcus pneumoniae
  misc_feature (1)..(40): "n or x" represents undefined/missing nucleotides or amino acides due to unavailable sequencing information.
nnnnnnnnnnnnnnnnnnnnnnnnnnnnnnnnnnnnnnnncttgaaattgctgagtccgatgtggaagttaaaaaagcggagcttgactagtaaagaggaagctaagaagcctttaaacgagggcacaattaggcaagcaaaagcggaagttgagagtaaaaaagctgaggctacaaggttagaaaaaatcaagacagatcgtaaaaaagcagaagaagaagctaaacgaagagcagcagaagaagataaagttaaagaaaaaccagctgaacaaccacaaccagcgccggcccctcaaccagaaaaaccaactgaagagcctgagaatccagttccagctccaaaaccagagaagccagctgaacaaccaaaaccagagaagccagctgaacaaccaaaaccagagaagccagctgaacaaccaaaagcagaaaaaacagatgatcaacaagctgaagaagactatgctcgtagatcagaagaagaatataatcgcttgactcaacagcaaccgcaaaaaccagagcaaccagctcctgcaccaaaaataggctggaaacaagaaaacggtatgtggtacttctacaatactgatggttcaatggcgacaggatggctccaatacaatggctcatggtattacctaaacgctaacggttcaatggcaacaggttgggtgaaagatggagatacctggtactatcttgaagcatcaggtgctatgaaagcaagccaatggttcaaagtatcagataaatggtactatgtcaatggctcaggtgcccttgcagtcaacacaactgtagatggctatggagtcaatgccaatggtgaatgggtaaac

SEQ ID NO: 299 - DNA, 1843 bp, Streptococcus pneumoniae
  misc_feature (757)..(796): "n or x" represents undefined/missing nucleotides or amino acides due to unavailable sequencing information.
atgtttgcatcaaaaagcgaaagaaaagtacattattcaattcgtaaatttagtgttggagtagctagtgtagctgttgccagtcttgttatgggaagtgtggttcatgcgacagagaacgagagaactacccaagtacccacttcttctaataggggaaagccagaacgtaggaaagctgctgaacaattcgatgaatatataaacaaaatgatccaattagataaaagaaaacatacccaaaatttagccttcaacatacagttgagcagaattaaaacggagtatttgaatggattaaaagagaagtcggaagctgagttgccgtcaaaaataaaagcagagttagacgcagcttttaagcagtttaaaaaagatacattaccaacagaaccagaaaaaaaagtagcagaagctgagaagaaggttgaagaagctgagaagaaggtagcagaagctaagaaaaaagccaaggctcaaaaagaagaagatcaccgtaactacccaaccattacttacaaaacgcttgaccttgaaattgctgagttcgatgtgaaagttaaagaagcggagcttgaactagtaaaaaaggaagctgacgaatctcgaaacgagggcacaattaaccaagcaaaagcgaaagttgagagtgaaaaagctgaggctacaaggttaaaaaaaatcaagacagatcgtgaaaaagcagaagaagaagaagctaaacgaagagcagatgctaaagagcaagatgaatcannnnnnnnnnnnnnnnnnnnnnnnnnnnnnnnnnnnnnnnattgctgagtccgatgtgaaagttaaagaagcggagcttgaactagtaaaagaggaagctaaggaatctcgaaacgaggaaaaaattaagcaagcaaaagcgaaagttgagagtaaaaaagctgaggctacaaggttagaaaaaatcaagacagatcgtaaaaaagcagaagaagaagctaaacgaaaagcagcagaagaagataaagttaaagaaaaaccagctgaacaaccacaaccagcgccggctccaaaaccagagaatccagctgaagagcctgagaatccagttccagctccaaaaccagagaatccagctgaacaaccaaaagcagaaaaaccagctgatcaacaagctgaagaagactatgctcgtagatcagaagaagaatataatcgcttgactcaacagcaaccgccaaaaccagagcaaccagctcctgcaccaaaaataggctggaaacaagaaaacggtatgtggtacttctacaatactgatggttcaatggcgaccggatggctccaaaacaatggctcatggtactacctcaacagcaatggcgctatggcgacaggatggctccaaaacaatggttcatggtactatctaaacgctaatggttcaatggcaacaggatggctccaaaacaatggttcatggtactacctcaacgctaatggtgatatggcgacaggatggctccaatacaatggctcatggtactacctcaacgctaatggtgatatggcgacaggatggctccaatacaatggctcatggtactacctaaacgctaatggtgatatggcgacaggatggctccaatacaatggctcatggtactatctaaacgctaatggtgatatggcgacaggttgggtgaaagatggagatacctggtactatcttgaagcatcaggtgctatgaaagcaagccaatggttcaaagtatcagataaatggtactatgtcaatggctcaggtgcccttgcagtcaacacaactgtagacggctatggagtcaatgccaatggtgaatgggtaaac

SEQ ID NO: 300 - DNA, 1654 bp, Streptococcus pneumoniae
  misc_feature (682)..(721): "n or x" represents undefined/missing nucleotides or amino acides due to unavailable sequencing information.
atgtttgcatcaaaaagcgaaagaaaagtacattattcaattcgtaaatttagtattggagtagctagtgtagctgttgctagcttgttcttaggaggagtagtccatgcagaaggggttagaagtgagaatacccccaaggttacatctagtggggatgaagtcgatgaatatataaaaaaaatgttgagtgagatccaattagataaaagaaaacatacccacaatttcgccttaaacctaaagttgagcagaattaaaacggagtatttgtataaattaaaagttaatgttttagaagaaaagtcaaaagctgagttgacgtcaaaaacaaaaaaagaggtagacgcagcttttgagaagtttaaaaaagatacattgaaactaggagaaaaggtagcagaagcacagaagaaggttgaagaagctaagaaaaaagccaaggatcaaaaagaagaagatcaccgtaactacccaaccaatacttacaaaacgcttgaacttgaaattgctgagtccgatgtgaaagttaaagaagcggagcttgaactattgaaagaggaagctaaaactcgaaacgaggacacaattaaccaagcaaaagcgaaagttaagagtgaacaagctgaggctacaaggttaaaaaaaatcaagacagatcgtgaacaagctgaggctacannnnnnnnnnnnnnnnnnnnnnnnnnnnnnnnnnnnnnnnattgctgagtccgatgtgaaagttaaagaagcggagcttgaactagtaaaagaggaagctaaggaacctcgagacgaggaaaaaattaagcaagcaaaagcggaagttgagagtaaacaagctgaggctacaaggttagaaaaaatcaagacagatcgtaaaaaagcagaagaagaagctaaacgaaaagcagcagaagaagataaagttaaagaaaaaccagctgaacaaccacaaccagcgccggctcctcaaccagaaaaaccaactccaaaaccagaaaaaccagctccagctccaaaaccagagaatccagctgaacaaccaaaagcagaaaaaccagctgatcaacaagctgaagaagactatgctcgtagatcagaagaagaatataatcgcttgactcaacagcaaccgccaaaaactgaaaaaccagcacaaccatctactccaaaaacaggctggaaacaagaaaacggtatgtggtacttctacaatactgatggttcaatggcgacaggatggctccaatacaatggctcatggtactacctaaacgctaatggtgatatggcgacaggatggctccaaaacaatggttcatggtactacctaaacgctaatggtgatatggcgacaggatggctccaaaacaatggctcatggtactacctaaacgctaatggtgatatggcgacaggatggctccaaaacaatggctcatggtactacctaaacgctaatggtgatatggcgacaggttgggtgaaagatggagatacctggtactatcttgaagcatcaggtgctatgaaagcaagccaatggttcaaagcatcagataaatggtactatgtcaatggctcaggtgcccttgcagtcaacacaactgtagatggctatggagtcaatgccaatggtgaatgggtaaac

SEQ ID NO: 301 - DNA, 1751 bp, Streptococcus pneumoniae
  misc_feature (722)..(761): "n or x" represents undefined/missing nucleotides or amino acides due to unavailable sequencing information.
atgtttgcatcaaaaagcgaaagaaaagtacattattcaattcgtaaatttagtattggagtagctagtgtagctgttgccagtcttgttatgggaagtgtggttcatgcgacagagaaggaggtaactacccaagtacccacttattctaatatggcaaagacagaacataggaaagctgctaaacaagtcgtcgatgaatatatagaaaaaatgttgagggagattcaattagatagaagaaaacatacccaaaatttcgccttcaacatgaagttgagcgcaattaaaacggagtatttgtatggattaaaagagaagtcggaagctgagttgccgtcatcggaagctgagttgccgtcagaagtaaaagcaaagttagacgcagcttttgagcagtttaaaaaagatacattgaaactaggagaaaaggtagcagaagctgagaagaaggttgcagaagctgagaaaaaagccaaggctcaaaaagaagaagatcgccgtaactacccaaccattacttacaaaacgcttgaccttgaaattgctgagtccgatgtggaagttaaaaaagcggagcttgaactattgaaagaggaagctaaaactcgaaacaaggacacaattaagcaagcaaaagcgaaagttgagagtaaaaaagctgaggctacaaagttagaagaaatcaagacagatcgtaaaaaagcagaagaagaagctannnnnnnnnnnnnnnnnnnnnnnnnnnnnnnnnnnnnnnnattgctgagtccgatgtgaaagttaaagaagcggagcttgaactagtaaaagaggaagctaaggaatctcgaaacgaggaaaaagttaagcaagcaaaagcgaaagttgagagtaaaaaagctgaggctacaaggttagaaaaaatcaagacagatcgtaaaaaagcagaagaagctaaacgaagagcagcagaagaagataaagttaaagaaaaaccagctgaacaaccacaaccagcgccggctcctcaaccagaaaaaccaactgaagagcctgagaatccagctccagctccaaaacctgagaaaccagctgaacaaccaaaagcagaaaaaccagctgatcaacaagctgaagaagactatgctcgtagatcagaagaagaatataatcgcttgactcaacagcaaccgccaaaaactgaaaaaccagcacaaccatctactccaaaaacaggctggaaacaagaaaacggtatgtggtacttctacaatactgatggttcaatggcgacaggatggctccaaaacaatggctcatggtactacctcaacagcaatggcgctatggcgacaggatggctccaatacaatggttcatggtactacctcaacgctaatggtgatatggcgacaggatggctccaaaacaatggttcatggtactacctcaacgctaatggtgatatggcgacaggatggctccaatacaatggttcatggtactacctcaacgctaatggtgatatggcgacaggatggctccaaaacaatggctcatggtactacctaaacgctaatggtgatatggcgacaggttgggtgaaagatggagatacctggtactatcttgaagcatcaggtgctatgaaagcaagccaatggttcaaagtatcagataaatggtactatgtcaatggctcaggtgcccttgcagtcaacacaactgtagatggctatggagtcaatgccaatggtgaatgggtaacc

SEQ ID NO: 302 - DNA, 1699 bp, Streptococcus pneumoniae
  misc_feature (742)..(781): "n or x" represents undefined/missing nucleotides or amino acides due to unavailable sequencing information.
atgtttgcatcaaaaagcgaaagaaaagtacattattcaattcgtaaatttagtattggagtagctagtgtagctgttgctagcttgttcttaggaggagtagtccatgcagaaggggttagaagtgagaatacccccaaggttacatctagtggggatgaagtcgatgaatatataaaaaaaatgttgagtgagatccaattagataaaagaaaacatacccacaatttcgccttaaacctaaagttgagcagaattaaaacggagtatttgtataaattaaaagttaatgttttagaagaaaagtcaaaagctgagttgacgtcaaaaacaaaaaaagaggtagacgcagcttttgagaagtttaaaaaagatacattgaaactaggagaaaaggtagcagaagctcagaagaaggttgaagaagctaagaaaaaagccaaggatcaaaaagaagaagatcaccgtaactacccaaccaatacttacaaaacgcttgaacttgaaattgctgagtccgatgtgaaagttaaagaagcggagcttgaactattgaaagaggaagctaaaactcgaaacgaggacacaattaaccaagcaaaagcgaaagttaagagtgaacaagctgaggctacaaggttaaaaaaaatcaagacagatcgtgaacaagctgaggctacaaggttagaaaacatcaagacagatcgtgaaaaagcagaagaagctaaacgaaaagcagaannnnnnnnnnnnnnnnnnnnnnnnnnnnnnnnnnnnnnnncttgaaattgctgagtccgatgtgaaagttaaagaagcggagcttgaactagtaaaagaggaagctaaggaatctcgaaacgaggaaaaagttaagcaagcaaaagcgaaagttgagagtaaacaagctgaggctacaaggttagaaaaaatcaagacagatcgtaaaaaagcagaagaagaagctaaacgaaaagcagcagaagaagataaagttaaagaaaaaccagctgaacaaccacaaccagcgccggctcctcaaccagaaaaaccagctccagctccaaaaccagagaatccagctgaacaaccaaaagcagaaaaaccagctgatcaacaagctgaagaagactatgctcgtagatcagaagaagaatataatcgcttgactcaacagcaaccgccaaaaactgaaaaaccagcacaaccatctactccaaaaacaggctggaaacaagaaaacggtatgtggtacttctacaatactgatggttcaatggcgacaggatggctccaatacaatggctcatggtactacctaaacgctaatggtgatatggcgacaggatggctccaaaacaatggttcatggtactacctaaacgctaatggtgatatggcgacaggatggctccaaaacaatggctcatggtactacctaaacgctaatggtgatatggcgacaggatggctccaaaacaatggctcatggtactacctaaacgctaatggtgatatggcgacaggttgggtgaaagatggagatacctggtactatcttgaagcatcaggtgctatgaaagcaagccaatggttcaaagcatcagataaatggtactatgtcaatggctcaggtgcccttgcagtcaacacaactgtagatggctatggagtcaatgccaatggtgaatgggtaaac

SEQ ID NO: 303 - DNA, 1413 bp, Streptococcus pneumoniae
  misc_feature (669)..(708): "n or x" represents undefined/missing nucleotides or amino acides due to unavailable sequencing information.
atgtttgcatcaaaaagcgaaagaaaagtacattattcaattcgtaaatttagtattggagtagctagtgtagctgttgccagtctttttatgggaagtgtggttcatgcgacagagaaggaggtaactacccaagtagccacttcttctaataaggcaaataaaagtcagacagaacatatgaaagctgctaaacaagtcgatgaatatataaaaaaaaagctccaattagatagaagaaaacatacccaaaatgtcggcttactcacaaagttgggcgtaattaaaacggagtatttgcatggattaagtgtttcaaaaaagaagtcggaagctgagttgccgtcagaaataaaagcaaagttagacgcagcttttgagcagtttaaaaaagatacattaccaacagaaccaggaaaaaaggtagcagaagctgagaagaaggttgaagaagctaagaaaaaagccgaggatcaaaaagaaaaagatctccgtaactacccaaccaatacttacaaaacgcttgaacttgacattgctgagtccgatgtggaagttaaaaaagcggagcttgaactagtaaaagggagctacaggaatctcgagacgagaaaaaaattaatcaagcaaagcgaaaagttgagaataaaaaagctgatgctacaaggnnnnnnnnnnnnnnnnnnnnnnnnnnnnnnnnnnnnnnnngtccaaaacggtatgtggtacttctacaatactgatggttcaatggcaacaggctggctccaaaacaatggctcatggtactacctcaacagcaatggcgctatggcgacaggatggctccaaaacaatggctcatggtactacctcaacagcaatggcgctatggcgacaggatggctccaatacaatggttcatggtactacctcaacgctaatggtgatatggcgacaggatggttccaatacaatggttcatggtactacctcaacgctaatggtgatatggcgacaggatggttccaatacaatggttcatggtactacctcaacgctaatggtgatatggcgacaggatggttccaatacaatggttcatggtactacctcaacgctaatggtgatatggcgacaggatggctccaatacaatggttcatggtactacctaaacagcaatggtgctatggtaacaggatggctccaaaacaatggctcatggtactacctaaacgctaacggttcaatggcaacagattgggtgaaagatggagatacctggtactatcttgaagcatcaggtgctatgaaagcaagccaatggttcaaagtatcagataaatggtactatgtcaatggctcaggtgcccttgcagtcaacacaactgtagatagctatagagtcaatgccaatggtgaatgggtaaac

SEQ ID NO: 304 - protein, 392 aa, Streptococcus pneumoniae
MKKKILASLLLSTVMVSQVAVLTTAHAETTDDKIAAQDNKISNLTAQQQEAQKQVDQIQEQVSAIQAEQSNLQAENDRLQAESKKLEGEITELSKNIVSRNQSLEKQARSAQTNGAVTSYINTIVNSKSITEAISRVAAMSEIVSANNKMLEQQKADKKAISEKQVANNDAINTVIANQQKLADDAQALTTKQAELKAAELSLAAEKATAEGEKASLLEQKAAAEAEARAAAVAEAAYKEKRASQQQSVLASANTNLTAQVQAVSESAAAPVRAKVRPTYSTNASSYPIGECTWGVKTLAPWAGDYWGNGAQWATSAAAAGFRTGSTPQVGAIACWNDGGYGHVAVVTAVESTTRIQVSESNYAGNRTIGNHRGWFNPTTTPEGFVTYIYAD

SEQ ID NO: 305 - protein, 392 aa, Streptococcus pneumoniae
MKKKILASLLLSTVMVSQVAVLTTAHAETTDDKIAAQDNKISNLTAQQQEAQKQVDQIQEQVSAIQAEQSNLQAENDRLQAESKKLEGEITELSKNIVSRNQSLEKQARSAQTNGAVTSYINTIVNSKSITEAISRVAAMSEIVSANNKMLEQQKADKKAISEKQVANNDAINTVIANQQKLADDAQALTTKQAELKAAELSLAAEKATAEGEKASLLEQKAAAEAEARAAAVAEAAYKEKRAGQQQSVLASANTNLTAQVQAVSESAAAPVRAKVRPTYSTNASSYPIGECTWGVKTLAPWAGDYWGNGAQWATSAAAAGFRTGSTPQVGAIACWNDGGYGHVAVVTAVESTTRIQVSESNYAGNRTIGNHRGWFNPTTTSEGFVTYIYAD

SEQ ID NO: 306 - protein, 587 aa, Streptococcus pneumoniae
MIQIGKIFAGRYRIVKQIGRGGMADVYLAKDLILDGEEVAVKVLRTNYQTDPIAVARFQREARAMADLDHPHIVRITDIGEEDGQQYLAMEYVAGLDLKRYIKEHYPLSNEEAARIMGQILLAMRLAHTRGIVHRDLKPQNILLTPDGTAKVTDFGIAVAFAETSLTQTNSMLGSVHYLSPEQAGGSKATVQSDIYAMGIIFYEMLTGHIPYDGDSAVTIALQHFQKPLPSVIAENPSVPQALENVIIKATAKKLTNRYRSVSEMYVDLSSSLSYNRRNESKLIFDETSKADTKTLPKVSQSTLTSIPKVQAQTEHKSIKNPSQAVTEETYQPQAPKKHRFKMRYLILLASLVLVAASLIWILSRTPATIAIPDVAGQTVAEAKATLKKANFEIGEEKTEASEKVEEGRIIRTDPGAGTGRKEGTKINLVVSSGKQSFQISNYVGRKSSDVIAELKEKKVPDNLIKIEEEESNESEAGTVLKQSLPEGTTYDLSKATQIVLTVAKKVTSVAMPSYIGSSLEFTKNNLIQIVGIKEANIEVVEVTTAPAGSAEGMVVEQSPRAGEKVDLNKTRVKISIYKPKTTSATP

SEQ ID NO: 307 - protein, 659 aa, Streptococcus pneumoniae
MIQIGKIFAGRYRIVKQIGRGGMADVYLAKDLILDGEEVAVKVLRTNYQTDPIAVARFQREARAMADLDHPHIVRITDIGEEDGQQYLAMEYVAGLDLKRYIKEHYPLSNEEAVRIMGQILLAMRLAHTRGIVHRDLKPQNILLTPDGTAKVTDFGIAVAFAETSLTQTNSMLGSVHYLSPEQARGSKATVQSDIYAMGIIFYEMLTGHIPYDGDSAVTIALQHFQKPLPSVIAENPSVPQALENVIIKATAKKLTNRYRSVSEMYVDLSSSLSYNRRNESKLIFDETSKADTKTLPKVSQSTLTSIPKVQAQTEHKSIKNPSQAVTEETYQPQAPKKHRFKMRYLILLASLVLVAASLIWILSRTPATIAIPDVAGQTVAEAKATLKKANFEIGEEKTEASEKVEEGRIIRTDPGAGTGRKEGTKINLVVSSGKQSFQISNYVGRKSSDVIAELKEKKVPDNLIKIEEEESNESEAGTVLKQSLPEGTTYDLSKATQIVLTVAKKATTIQLGNYIGRNSTEVISELKQKKVPENLIKIEEEESSESEPGTIMKQSPGAGTTYDVSKPTQIVLTVAKKVTSVAMPSYIGSSLEFTKNNLIQIVGIKEANIEVVEVTTAPAGSVEGMVVEQSPRAGEKVDLNKTRVKISIYKPKTTSATP

SEQ ID NO: 308 - protein, 659 aa, Streptococcus pneumoniae
MIQIGKIFAGRYRIVKQIGRGGMADVYLAKDLILDGEEVAVKVLRTNYQTDPIAVARFQREARAMADLDHPHIVRITDIGEEDGQQYLAMEYVAGLDLKRYIKEHYPLSNEEAVRIMGQILLAMRLAHTRGIVHRDLKPQNILLTPDGTAKVTDFGIAVAFAETSLTQTNSMLGSVHYLSPEQARGSKATVQSDIYAMGIIFYEMLTGHIPYDGDSAVTIALQHFQKPLPSVIAENPSVPQALENVIIKATAKKLTNRYRSVSEMYVDLSSSLSYNRRNESKLIFDETSKADTKTLPKVSQSTLTSIPKVQAQTEHKSIKNPSRAVTEETYQPQAPKKHRFKMRYLILLASLVLVAASLIWILSRTPATIAIPDVAGQTVAEAKATLKKANFEIGEEKTEASEKVEEGRIIRTDPGAGTGRKEGTKINLVVSSGKQSFQISNYVGRKSSDVIAELKEKKVPDNLIKIEEEESNESEAGTVLKQSLPEGTTYDLSKATQIVLTVAKKATTIQLGNYIGRNSTEVISELKQKKVPENLIKIEEEESSESEPGTIMKQSPGAGTTYDVSKPTQIVLTVAKKVTSVAMPSYIGSSLEFTKNNLIQIVGIKEANIEVVEVTTAPAGSAEGMVVEQSPRAGEKVDLNKTRVKTSIYKPKTTSATP

SEQ ID NO: 309 - protein, 659 aa, Streptococcus pneumoniae
MIQIGKIFAGRYRIVKQIGRGGMADVYLAKDLILDGEEVAVKVLRTNYQTDPIAVARFQREARAMADLDHPHIVRITDIGEEDGQQYLAMEYVAGLDLKRYIKEHYPLSNEEAVRIMGQILLAMRLAHTRGIVHRDLKPQNILLTPDGTAKVTDFGIAVAFAETSLTQTNSMLGSVHYLSPEQARGSKATVQSDIYAMGIIFYEMLTGHIPYDGDSAVTIALQHFQKPLPSVIAENPSVPQALENVIIRATAKKLTNRYRSVSEMYVDLSSSLSYNRRNESKLIFDETSKADTKTLPKVSQSTLTSIPKVQAQTGHKSIKNPSQAVTEETYQPQAPKKHRFKMRYLILLASLVLVAASLIWILSRTPATIAIPDVAGQTVAEAKATLKKANFEIGEEKTEASEKVEEGRIIRTDPGAGTGRKEGTKINLVVSSGKQSFQISNYVGRKSSDVIAELKEKKVPDNLIKIEEEESNESEAGTVLKQSLPEGTTYDLSKATQIILTVAKKATTIQLGNYIGRNSTEVISELKQKKVPENLIKIEEEESSESEPGTIMKQSPGAGTTYDVSKPTQIVLTVAKKVTSVAMPSYIGSSLEFTKNNLIQIVGIKEANIEVVEVTTAPAGSAEGMVVEQSPRAGEKVDLNKTRVKISIYKPKTTSATP

SEQ ID NO: 310 - protein, 659 aa, Streptococcus pneumoniae
MIQIGKIFAGRYRIVKQIGRGGMADVYLAKDLILDGEEVAVKVLRTNYQTDPIAVARFQREARAMADLDHPHIVRITDIGEEDGQQYLAMEYVAGLDLKRYIKEHYPLSNEEAVRIMGQILLAMRLAHTRGIVHRDLKPQNILLTPDGTAKVTDFGIAVAFAETSLTQTNSMLGSVHYLSPEQARGSKATVQSDIYAMGIIFYEMLTGHIPYDGDSAVTIALQHFQNPLPSVIAENSSVPQALENVIIKATAKKLTNRYRSVSEMYVDLSSSLSYNRRNESKLIFDETSKADTKTLPKVSQSTLTSIPKVQAQTEHKSIKNPSQAVTEETYQPQAPKKHRFKMRYLILLASLVLVAASLIWILSRTPATIAIPDVAGQTVAEAKATLKKANFEIGEEKTEASEKVEEGRIIRTDPGAGTGRKEGTKINLVVSSGKQSFQISNYVGRKSSDVIAELKEKKVPDNLIKIEEEESNESEAGTVLKQSLPEGTTYDLSKATQIVLTVAKKATTIQLGNYIGRNSTEVISELKQKKVPENLIKIEEEESSESEPGTIMKQSPGAGTTYDVSKPTQIVLTVAKKVTSVAMPSYIGSSLEFTKNNLIQIVGIKEANIEVVEVTTAPAGSVEGMVVEQSPRAGEKVDLNKTRVKISIYKPKTTSATP

SEQ ID NO: 311 - protein, 701 aa, Streptococcus pneumoniae
MFASKSERKVHYSIRKFSIGVASVAVASLVMGSVVHATENEGSTQAATSSNMAKTEHRKAAKQVVDEYIEKMLREIQLDRRKHTQNVALNIKLSAIKTKYLRELNVLEEKSKDELPSEIKAKLDAAFEKFKKDTLKPGEKVAEAKKKVEEAKKKAEDQKEEDRRNYPTNTYKTLELEIAEFDVKVKEAELELVKEEAKESRNEGTIKQAKEKVESKKAEATRLENIKTDRKKAEEEAKRKADAKLKEANVATSDQGKPKGRAKRGVPGELATPDKKENDAKSSDSSVGEETLPSSSLKSGKKVAEAEKKVEEAEKKAKDQKEEDRRNYPTNTYKTLDLEIAESDVKVKEAELELVKEEAKEPRDEEKIKQAKAKVESKKAEATRLENIKTDRKKAEEEAKRKAAEEDKVKEKPAEQPQPAPATQPEKPAPKPEKPAEQPKAEKTDDQQAEEDYARRSEEEYNRLTQQQPPKTEKPAQPSTPKTGWKQENGMWYFYNTDGSMATGWLQNNGSWYYLNANGAMATGWLQNNGSWYYLNANGSMATGWLQNNGSWYYLNANGAMATGWLQYNGSWYYLNSNGAMATGWLQYNGSWYYLNANGDMATGWLQNNGSWYYLNANGDMATGWLQYNGSWYYLNANGDMATGWVKDGDTWYYLEASGAMKASQWFKVSDKWYYVNGSGALAVNTTVDGYGVNANGEWVN

SEQ ID NO: 312 - protein, 536 aa, Streptococcus pneumoniae
  MISC_FEATURE (164)..(213): "n or x" represents undefined/missing nucleotides or amino acides due to unavailable sequencing information.
MFASKSERKVHYSIRKFSVGVASVVVASLVMGSVVHATENEGATQVPTSSNRANESQAEQGEQPKKLDSERDKARKEVEEYVKKIVGESYAKSTKKRHTITVALVNELNNIKNEYLNKIVESTSESQLQILMMESRSKVDEAVSKFEKDSPSSSSSDSSTKPEXXXXXXXXXXXXXXXXXXXXXXXXXXXXXXXXXXXXXXXXXXXXXXXXXXAESDVEVKKAELELVKEEAKEPRNEEKVKQAKAEVESKKAEATRLEKIKTDRKKAEEEAKRKAAEEDKVKEKPAEQPQPAPAPKAEKPAPAPKPENPAEQPKAEKPADQQAEEDYARRSEEEYNRLTQQQPPKTEKPAQPSTPKTGWKQENGMWYFYNTDGSMATGWLQNNGSWYYLNSNGAMATGWLQNNGSWYYLNANGSMATGWLQNNGSWYYLNANGSMATGWLQYNGSWYYLNANGSMATGWLQYNGSWYYLNANGDMATGWVKDGDTWYYLEASGAMKASQWFKVSDKWYYVNGSGALAVNTTVDGYGVNANGEWVN

SEQ ID NO: 313 - protein, 319 aa, Streptococcus pneumoniae
  MISC_FEATURE (1)..(51): "n or x" represents undefined/missing nucleotides or amino acides due to unavailable sequencing information.
XXXXXXXXXXXXXXXXXXXXXXXXXXXXXXXXXXXXXXXXXXXXXXXXXXXLKLLSPMWKLKKRSLTSKEEAKKPLNEGTIRQAKAEVESKKAEATRLEKIKTDRKKAEEEAKRRAAEEDKVKEKPAEQPQPAPAPQPEKPTEEPENPVPAPKPEKPAEQPKPEKPAEQPKPEKPAEQPKAEKTDDQQAEEDYARRSEEEYNRLTQQQPQKPEQPAPAPKIGWKQENGMWYFYNTDGSMATGWLQYNGSWYYLNANGSMATGWVKDGDTWYYLEASGAMKASQWFKVSDKWYYVNGSGALAVNTTVDGYGVNANGEWVN

SEQ ID NO: 314 - protein, 631 aa, Streptococcus pneumoniae
  MISC_FEATURE (253)..(302): "n or x" represents undefined/missing nucleotides or amino acides due to unavailable sequencing information.
MFASKSERKVHYSIRKFSVGVASVAVASLVMGSVVHATENERTTQVPTSSNRGKPERRKAAEQFDEYINKMIQLDKRKHTQNLAFNIQLSRIKTEYLNGLKEKSEAELPSKIKAELDAAFKQFKKDTLPTEPEKKVAEAEKKVEEAEKKVAEAKKKAKAQKEEDHRNYPTITYKTLDLEIAEFDVKVKEAELELVKKEADESRNEGTINQAKAKVESEKAEATRLKKIKTDREKAEEEEAKRRADAKEQDESXXXXXXXXXXXXXXXXXXXXXXXXXXXXXXXXXXXXXXXXXXXXXXXXXXIAESDVKVKEAELELVKEEAKESRNEEKIKQAKAKVESKKAEATRLEKIKTDRKKAEEEAKRKAAEEDKVKEKPAEQPQPAPAPKPENPAEEPENPVPAPKPENPAEQPKAEKPADQQAEEDYARRSEEEYNRLTQQQPPKPEQPAPAPKIGWKQENGMWYFYNTDGSMATGWLQNNGSWYYLNSNGAMATGWLQNNGSWYYLNANGDMATGWLQYNGSWYYLNANGDMATGWLQYNGSWYYLNANGDMATGWLQYNGSWYYLNANGDMATGWVKDGDTWYYLEASGAMKASQWFKVSDKWYYVNGSGALAVNTTVDGYGVNANGEWVN

SEQ ID NO: 315 - protein, 588 aa, Streptococcus pneumoniae
  MISC_FEATURE (228)..(277): "n or x" represents undefined/missing nucleotides or amino acides due to unavailable sequencing information.
MFASKSERKVHYSIRKFSIGVASVAVASLFLGGVVHAEGVRSENTPKVTSSGDEVDEYIKKMLSEIQLDKRKHTHNFALNLKLSRIKTEYLYKLKVNVLEEKSKAELTSKTKKEVDAAFEKFKKDTLKLGEKVAEAQKKVEEAKKKAKDQKEEDHRNYPTNTYKTLELEIAESDVKVKEAELELLKEEAKTRNEDTINQAKAKVKSEQAEATRLKKIKTDREQAEATXXXXXXXXXXXXXXXXXXXXXXXXXXXXXXXXXXXXXXXXXXXXXXXXXXIAESDVKVKEAELELVKEEAKEPRDEEKIKQAKAEVESKQAEATRLEKIKTDRKKAEEEAKRKAAEEDKVKEKPAEQPQPAPAPQPEKPTPKPEKPAPAPKPENPAEQPKAEKPADQQAEEDYARRSEEEYNRLTQQQPPKTEKPAQPSTPKTGWKQENGMWYFYNTDGSMATGWLQYNGSWYYLNANGDMATGWLQNNGSWYYLNANGDMATGWLQNNGSWYYLNANGDMATGWLQNNGSWYYLNANGDMATGWVKDGDTWYYLEASGAMKASQWFKASDKWYYVNGSGALAVNTTVDGYGVNANGEWVN

SEQ ID NO: 316 - protein, 620 aa, Streptococcus pneumoniae
  MISC_FEATURE (241)..(290): "n or x" represents undefined/missing nucleotides or amino acides due to unavailable sequencing information.
MFASKSERKVHYSIRKFSIGVASVAVASLVMGSVVHATEKEVTTQVPTYSNMAKTEHRKAAKQVVDEYIEKMLREIQLDRRKHTQNFAFNMKLSAIKTEYLYGLKEKSEAELPSSEAELPSEVKAKLDAAFEQFKKDTLKLGEKVAEAEKKVAEAEKKAKAQKEEDRRNYPTITYKTLDLEIAESDVEVKKAELELLKEEAKTRNKDTIKQAKAKVESKKAEATKLEEIKTDRKKAEEEAXXXXXXXXXXXXXXXXXXXXXXXXXXXXXXXXXXXXXXXXXXXXXXXXXXIAESDVKVKEAELELVKEEAKESRNEEKVKQAKAKVESKKAEATRLEKIKTDRKKAEEAKRRAAEEDKVKEKPAEQPQPAPAPQPEKPTEEPENPAPAPKPEKPAEQPKAEKPADQQAEEDYARRSEEEYNRLTQQQPPKTEKPAQPSTPKTGWKQENGMWYFYNTDGSMATGWLQNNGSWYYLNSNGAMATGWLQYNGSWYYLNANGDMATGWLQNNGSWYYLNANGDMATGWLQYNGSWYYLNANGDMATGWLQNNGSWYYLNANGDMATGWVKDGDTWYYLEASGAMKASQWFKVSDKWYYVNGSGALAVNTTVDGYGVNANGEWVN

SEQ ID NO: 317 - protein, 603 aa, Streptococcus pneumoniae
  MISC_FEATURE (248)..(297): "n or x" represents undefined/missing nucleotides or amino acides due to unavailable sequencing information.
MFASKSERKVHYSIRKFSIGVASVAVASLFLGGVVHAEGVRSENTPKVTSSGDEVDEYIKKMLSEIQLDKRKHTHNFALNLKLSRIKTEYLYKLKVNVLEEKSKAELTSKTKKEVDAAFEKFKKDTLKLGEKVAEAQKKVEEAKKKAKDQKEEDHRNYPTNTYKTLELEIAESDVKVKEAELELLKEEAKTRNEDTINQAKAKVKSEQAEATRLKKIKTDREQAEATRLENIKTDREKAEEAKRKAEXXXXXXXXXXXXXXXXXXXXXXXXXXXXXXXXXXXXXXXXXXXXXXXXXXLEIAESDVKVKEAELELVKEEAKESRNEEKVKQAKAKVESKQAEATRLEKIKTDRKKAEEEAKRKAAEEDKVKEKPAEQPQPAPAPQPEKPAPAPKPENPAEQPKAEKPADQQAEEDYARRSEEEYNRLTQQQPPKTEKPAQPSTPKTGWKQENGMWYFYNTDGSMATGWLQYNGSWYYLNANGDMATGWLQNNGSWYYLNANGDMATGWLQNNGSWYYLNANGDMATGWLQNNGSWYYLNANGDMATGWVKDGDTWYYLEASGAMKASQWFKASDKWYYVNGSGALAVNTTVDGYGVNANGEWVN

SEQ ID NO: 318 - protein, 507 aa, Streptococcus pneumoniae
  MISC_FEATURE (223)..(272): "n or x" represents undefined/missing nucleotides or amino acides due to unavailable sequencing information.
MFASKSERKVHYSIRKFSIGVASVAVASLFMGSVVHATEKEVTTQVATSSNKANKSQTEHMKAAKQVDEYIKKKLQLDRRKHTQNVGLLTKLGVIKTEYLHGLSVSKKKSEAELPSEIKAKLDAAFEQFKKDTLPTEPGKKVAEAEKKVEEAKKKAEDQKEKDLRNYPTNTYKTLELDIAESDVEVKKAELELVKGSYRNLETRKKLIKQSEKLRIKKLMLQXXXXXXXXXXXXXXXXXXXXXXXXXXXXXXXXXXXXXXXXXXXXXXXXXXVQNGMWYFYNTDGSMATGWLQNNGSWYYLNSNGAMATGWLQNNGSWYYLNSNGAMATGWLQYNGSWYYLNANGDMATGWFQYNGSWYYLNANGDMATGWFQYNGSWYYLNANGDMATGWFQYNGSWYYLNANGDMATGWLQYNGSWYYLNSNGAMVTGWLQNNGSWYYLNANGSMATDWVKDGDTWYYLEASGAMKASQWFKVSDKWYYVNGSGALAVNTTVDSYRVNANGEWVN

The invention claimed is:

1. An isolated hyperimmune serum-reactive antigen consisting of a fragment of SEQ ID NO: 214, wherein said fragment comprises an amino acid sequence selected from the group consisting of amino acids: 9-18, 24-46, 51-58, 67-77, 85-108, 114-126, 129-137, 139-146, 152-165, 173-182, 188-195, 197-204, 217-250, 260-274, 296-313, 343-366, 368-384, 427-434, 437-446, 449-455, 478-484, 492-506, 522-527, 562-591, 599-606, 609-618, 625-631, 645-652, 577-654, 579-601, 596-618, 613-635 and 630-653 of SEQ ID NO: 214, and wherein said fragment is less than 659 amino acids in length.

2. An immunogenic composition comprising the isolated hyperimmune serum-reactive antigen of claim 1.

3. The immunogenic composition of claim 2, wherein the fragment comprises an amino acid sequence selected from the group consisting of amino acids: 579-601, 596-618, 613-635, 630-653 and 577-654 of SEQ ID NO: 214, and wherein said fragment is less than 659 amino acids in length.

4. The immunogenic composition of claim 3, further comprising at least one additional isolated hyperimmune serum-reactive antigen.

5. The immunogenic composition of claim 2, further comprising at least one additional isolated hyperimmune serum-reactive antigen.

6. The immunogenic composition of claim 5, wherein the at least one additional isolated hyperimmune serum-reactive antigen are directed against S. pneumoniae.

7. The immunogenic composition of claim 2, further comprising an immunostimulatory substance.

8. The immunogenic composition of claim 7, wherein the immunostimulatory substance is a polycationic polymer, an immunostimulatory oligodeoxynucleotide (ODN), a peptide containing at least two LysLeuLys motifs, a neuroactive compound, alum, or a Freund's complete or incomplete adjuvant.

9. The immunogenic composition of claim 8, wherein the polycationic polymer is a polycationic peptide.

10. The immunogenic composition of claim 8, wherein the neuroactive compound is human growth hormone.

11. A fusion protein comprising one or more serum-reactive antigens of SEQ ID NO: 214 as defined in claim 1, further comprising a heterologous amino acid sequence.

12. An immunogenic composition comprising the fusion protein of claim 11.

13. The immunogenic composition of claim 12, further comprising at least one additional isolated hyperimmune serum-reactive antigen.

14. The immunogenic composition of claim 13, wherein the additional isolated hyperimmune serum-reactive antigen is directed against S. pneumoniae.

15. The immunogenic composition of claim 12, further comprising an immunostimulatory substance.

16. The immunogenic composition of claim 15, wherein the immunostimulatory substance is a polycationic polymer, an immunostimulatory oligodeoxynucleotide (ODN), a peptide containing at least two LysLeuLys motifs, a neuroactive compound, alum, or Freund's complete or incomplete adjuvant.

17. The immunogenic composition of claim 16, wherein the polycationic polymer is a polycationic peptide.

18. The immunogenic composition of claim 16, wherein the neuroactive compound is human growth hormone.

19. The immunogenic composition of claim 12, wherein the fusion protein comprises one or more amino acid sequences of the fragment of SEQ ID NO: 214, selected from the group consisting of amino acids: 579-601, 596-618, 613-635, 630-653 and 577-654 of SEQ ID NO: 214.

20. The immunogenic composition of claim 19, further comprising at least one additional isolated hyperimmune serum-reactive antigen.

21. The fusion protein of claim 11, wherein the heterologous amino acid sequence comprises charged amino acids.

22. The fusion protein of claim 11, wherein the heterologous amino acid sequence is added to the N- or C-terminus of the polypeptide.

23. The fusion protein of claim 11, wherein the heterologous amino acid sequence comprises a constant region from an immunoglobulin.

24. A method of eliciting an immune response in a subject comprising administering to said subject
 a therapeutically effective amount of the hyperimmune serum-reactive antigen according to claim 1.

25. The method of claim 24, wherein the subject is a human.

26. The method of claim 24, wherein the immune response is directed against S. pneumoniae infection in the subject.

27. A method of eliciting an immune response in a subject comprising administering to said subject a therapeutically effective amount of the immunogenic composition of claim 2 or 12.

28. The method of claim 27, wherein the subject is a human.

29. The method of claim 27, wherein the immune response is directed against *S. pneumoniae* infection in the subject.

30. A method of eliciting an immune response in a subject comprising administering to said subject a therapeutically effective amount of a fusion protein according to claim 11.

* * * * *